United States Patent
Gibson et al.

(10) Patent No.: US 7,410,754 B1
(45) Date of Patent: Aug. 12, 2008

(54) $B_{12}$-DEPENDENT DEHYDRATASES WITH IMPROVED REACTION KINETICS

(75) Inventors: Katharine J. Gibson, Wilmington, DE (US); Der-Ing Liao, Newark, DE (US); Xiao-Song Tang, Hockessin, DE (US)

(73) Assignee: E.I. du Pont de Nemours and Company, Wilmington, DE (US)

( * ) Notice: Subject to any disclaimer, the term of this patent is extended or adjusted under 35 U.S.C. 154(b) by 257 days.

(21) Appl. No.: 10/738,052

(22) Filed: Dec. 16, 2003

Related U.S. Application Data

(60) Provisional application No. 60/433,708, filed on Dec. 16, 2002.

(51) Int. Cl.
*C12Q 1/527* (2006.01)
*C12N 9/88* (2006.01)

(52) U.S. Cl. .......................... 435/4; 435/232; 435/440

(58) Field of Classification Search ....................... None
See application file for complete search history.

(56) References Cited

U.S. PATENT DOCUMENTS

| | | | |
|---|---|---|---|
| 5,686,276 A | 11/1997 | Laffend et al. | |
| 2004/0014085 A1* | 1/2004 | Milano et al. | 435/6 |
| 2004/0015217 A1 | 1/2004 | Lofgren | |
| 2004/0023509 A1 | 2/2004 | Amemiya | |

FOREIGN PATENT DOCUMENTS

| | | |
|---|---|---|
| WO | WO 96/35796 | 11/1996 |
| WO | WO 98/21341 | 5/1998 |
| WO | WO 01/04324 A1 | 1/2001 |
| WO | WO 01/12833 A2 | 2/2001 |

OTHER PUBLICATIONS

Corinna Seifert et al., Identification and expression of the genes and purification and characterization of the gene products involved in reactivation of coenzyme B12-dependent glycerol dehydratase of *Citrobacter freundii*, Eur. J. Biochem., vol. 268:2369-2378, 2001.
Tetsuo Toraya et al., A Reactivating Factor for Coenzyme B12-dependent Diol Dehydratase, Journal of Biol. Chem., vol. 274(6):3372-3377,1999.
Takamasa Tobimatsu et al., Identification and Expression of the Genes Encoding a Reactivating Factor for Adenosylcobalamin-Dependent Glycerol Dehydratase, J. of Bacteriology, vol. 181(13):4110-4113, 1999.
Zeng et al., Bulk Chemicals from Biotechnology: The Case of 1,3-Propanediol Production and the New Trends, Adv. Biochem. Eng. Biotechnol., 74:239-259, 2002.
Maris G. Hartmanis et al., Diol Metabolism and Diol Dehydratase in *Clostridium glycolicum*, Arch. Biochem. Biophys., vol. 245:144-152, 1986.
Nicolas Sauvageot et al., Characterization of the diol dehydratase pdu operon of *Lactobacillus collinoides*, FEMS Microbiology Reviews, vol. 209:69-74, 1999.
Rolf Daniel et. al., Biochemistry of Coenzyme B12-Dependent Glycerol and Diol Dehydratases and Organization of the Encoding Genes, FEMS Microbiology Reviews, 1999, pp. 553-566, vol. 22.
A. Reimann et. al., 1,3-Propanediol Formation with Product-Tolerant Mutants of *Clostridium butyricum* DSM 5431 in Continuous Culture: Productivity, Carbon and Electron Flow, Journal of Applied Microbiology, 1998, vol. 84:1125-1130.
William W. Bachovchin et. al., Mechanism of Action of Adenosylcobalamin: Glycerol and Other Substrate Analogues as Substrates and Inactivators for Propanediol Dehydratase-Kinetics, Stereospecificity, and Mechanism, Biochemistry, 1977, vol. 16:1082-1092.
International Search Report Dated Jun. 20, 2006, International Application No. PCT/US03/40397, International Filing Date: Dec. 16, 2003.
Abbad-Andalouissi et al., "Isolation and Characterization of *Clostridium butyricum* DSM 5431 Mutants with Increased Resistance to 1,3-Propanediol and Altered Production of Acids", Applied and Environmental Microbiology. vol. 61, No. 12. Dec. 1995, pp. 4413-4417.
Supplementary European Search Report, Search Completed Apr. 18, 2007.

* cited by examiner

*Primary Examiner*—Rebecca Prouty

(57) ABSTRACT

Sequences of $B_{12}$-dependent dehydratases with improved reaction kinetics are presented. Use of these $B_{12}$-dependent dehydratases reduce the rate of the enzyme's suicide inactivation in the presence of glycerol and 1,3-propanediol. The enzymes were created using error-prone PCR and oligonucleotide-directed mutagenesis to target the DhaB1 gene, which encodes the α-subunit of glycerol dehydratase. Mutants with improved reaction kinetics were rapidly identified using high throughput assays.

3 Claims, 5 Drawing Sheets

$B_{12}$-DEPENDENT DEHYDRATASES WITH IMPROVED REACTION KINETICS

FIELD OF INVENTION

The present invention relates to the field of molecular biology and the use of $B_{12}$-dependent dehydratases to produce 1,3-propanediol. More specifically, it describes methods to create and select $B_{12}$-dependent dehydratases with improved reaction kinetics, such that the rate of enzyme inactivation is reduced.

BACKGROUND 1,3-Propanediol has utility in a number of applications, including as a starting material for producing polyesters, polyethers, and polyurethanes. Methods for producing 1,3-propanediol include both traditional chemical routes and biological routes. Biological methods for producing 1,3-propanediol have been recently described (Zeng et al., *Adv. Biochem. Eng. Biotechnol.*, 74:239-259 (2002)). Biologically producing 1,3-propanediol requires glycerol as a substrate for a two-step sequential reaction. First, a dehydratase (typically a coenzyme $B_{12}$-dependent dehydratase) converts glycerol to an intermediate, 3-hydroxypropionaldehyde (3-HP). Then, 3-HP is reduced to 1,3-propanediol by an NADH— (or NADPH) dependent oxidoreductase (See Equations 1 and 2).

Glycerol→3-HP+$H_2O$     (Equation 1)

3-HP+NADH+$H^+$→1,3-Propanediol+$NAD^+$     (Equation 2)

The 1,3-propanediol is not metabolized further and, as a result, accumulates in high concentration in the media.

Typically, glycerol is used as the starting material for biologically producing 1,3-propanediol. However, glucose and other carbohydrates also are suitable substrates for 1,3-propanediol production. Specifically, Laffend et al. (WO 96/35796; U.S. Pat. No. 5,686,276) disclose a method for producing 1,3-propanediol from a carbon substrate other than glycerol or dihydroxyacetone (especially, e.g., from glucose), using a single microorganism comprising a dehydratase activity. Emptage et al., (WO 01/012833) describe a significant increase in titer (grams product per liter) obtained by virtue of a non-specific catalytic activity (distinguished from the 1,3-propanediol oxidoreductase encoded by dha T) to convert 3-HP to 1,3-propanediol. Payne et al. (U.S. 60/374, 931) disclose specific vectors and plasmids useful for biologically producing 1,3-propanediol. Cervin et al. (U.S. 60/416, 192) disclose improved *E. coli* strains for high yield production of 1,3-propanediol. WO 96/35796, WO 01/012833, U.S. 60/374,931, and U.S. 60/416,192 are incorporated by reference in the instant specification as though set forth in their entirety herein.

The enzymes responsible for converting glycerol to 3-HP are largely coenzyme $B_{12}$-dependent enzymes, known as coenzyme $B_{12}$-dependent glycerol dehydratases (E.C. 4.2.1.30) and coenzyme $B_{12}$-dependent diol dehydratases (E.C. 4.2.1.28). These distinct, but related, coenzyme $B_{12}$-dependent enzymes are well studied in terms of their molecular and biochemical properties. Genes for coenzyme $B_{12}$-dependent dehydratases have been identified, for example, in *Klebsiella pneumoniae, Citrobacter freundii, Clostridium pasteurianum, Salmonella typhimurium, Klebsiella oxytoca*, and *Lactobacillus collinoides* (Toraya, T., In *Metalloenzymes Involving Amino Acid-Residue and Related Radicals*; Sigel, H. and Sigel, A., Eds.; Metal Ions in Biological Systems; Marcel Dekker: New York, 1994; Vol. 30, pp 217-254; Daniel et al., *FEMS Microbiology Reviews* 22:553-566 (1999); and Sauvageot et al., *FEMS Microbiology Letters* 209: 69-74 (2002)).

Although there is wide variation in the gene nomenclature used in the literature, in each case the coenzyme $B_{12}$-dependent dehydratase is composed of three subunits: the large or "α" subunit, the medium or "β" subunit, and the small or "γ" subunit. These subunits assemble in an $\alpha_2\beta_2\gamma_2$ structure to form the apoenzyme. Coenzyme $B_{12}$ (the active cofactor species) binds to the apoenzyme to form the catalytically active holoenzyme. Coenzyme $B_{12}$ is required for catalytic activity as it is involved in the radical mechanism by which catalysis occurs.

Biochemically, both coenzyme $B_{12}$-dependent glycerol and coenzyme $B_{12}$-dependent diol dehydratases are known to be subject to mechanism-based suicide inactivation by glycerol and other substrates (Daniel et al., supra; Seifert, et al., *Eur. J. Biochem.* 268:2369-2378 (2001)). In addition, inactivation occurs via interaction of the holoenzyme with high concentrations of 1,3-propanediol. Inactivation involves cleavage of the cobalt-carbon (Co—C) bond of the coenzyme $B_{12}$ cofactor, leading to the formation of 5'-deoxyadenosine and an inactive cobalamin species. The inactive cobalamin species remains tightly bound to the dehydratase; dissociation does not occur without the intervention of coenzyme $B_{12}$-dependent dehydratase reactivation factors ("dehydratase reactivation factors"). This inactivation can significantly decrease the reaction kinetics associated with 3-HP formation and, thus, indirectly decrease 1,3-propanediol production.

The effects of coenzyme $B_{12}$-dependent dehydratase inactivation can be partially overcome. For example, inactivation can be overcome by relying on those proteins responsible for reactivating the dehydratase activity. Dehydratase reactivation factors have been described in: WO 98/21341 (U.S. Pat. No. 6,013,494); Daniel et al. (supra); Toraya and Mori (*J. Biol. Chem.* 274:3372 (1999)); and Tobimatsu et al. (*J. Bacteriol.* 181:4110 (1999)). Reactivation occurs in a multi-step process. Initially, interaction of inactivated coenzyme $B_{12}$-dependent dehydratase with dehydratase reactivation factors, in an ATP-dependent process, results in the release of the tightly bound inactive cobalamin species to produce apoenzyme. Subsequently, the dehydratase apoenzyme may bind coenzyme $B_{12}$ to re-form the catalytically active holoenzyme and the inactive cobalamin species may be regenerated (by enzymatic action, in a separate ATP-dependent process) to coenzyme $B_{12}$. Depending solely on dehydratase reactivation factors to restore dehydratase activity is inherently limited, however, since both the dehydratase reactivation and the coenzyme $B_{12}$ regeneration processes require ATP. These ATP-dependent processes represent a significant energetic burden to the process of converting glycerol to 3-HP, particularly if a subsequent reaction of 3-HP to 1,3-propanediol is present and the 1,3-propanediol concentration is high.

Alternatively, it is possible to either increase the amount of coenzyme $B_{12}$ added to a medium during 1,3-propanediol production or to supplement the culture media with vitamin $B_{12}$ (which is converted to coenzyme $B_{12}$ in vivo) to supply additional coenzyme $B_{12}$ to microorganisms. However, in both cases, the cost of these additions may significantly interfere with process economics.

Croux et al. (WO 01/04324 A1) have addressed the problems associated with coenzyme $B_{12}$-dependent dehydratases by developing a process for produing 1,3-propanediol using a recombinant microorganism that expresses a coenzyme $B_{12}$-independent dehydratase. However, the usefulness of this solution may be limited by the ability of $B_{12}$-independent dehydratases to function under certain preferred process conditions (e.g. under aerobic conditions (Hartmanis and Stadman, *Arch. Biochem. Biophys.* 245:144-52 (1986)).

In principle, it should be possible to isolate coenzyme $B_{12}$-dependent dehydratases with reduced inactivation kinetics from naturally occurring microbial strains. Reduced inactivation kinetics would increase the turnover ratio (mol product/mol holoenzyme) of coenzyme $B_{12}$-dependent dehydratase in a microbial host, and thus, reduce the dehydratase and coenzyme $B_{12}$ demand. This approach would also reduce the energy needed to maintain that level of dehydratase and coenzyme $B_{12}$. However, in practice, the diversity of coenzyme $B_{12}$-dependent dehydratases has been found to be limited with respect to inactivation kinetics.

The problem to be solved, therefore, is that currently available coenzyme $B_{12}$-dependent dehydratase enzymes are unable to provide the reaction kinetics needed for industrial applications for the production of industrial compounds.

SUMMARY OF THE INVENTION

Applicants have provided a method of screening for $B_{12}$-dependent dehydratases having improved reaction kinetics, comprising:
(a) contacting a $B_{12}$-dependent dehydratase holoenzyme with a mixture comprising glycerol and 1,3-propandiol, wherein the 1,3-propanediol is at least 25 mM;
(b) screening the $B_{12}$-dependent dehydratase holoenzyme to estimate the turnover ratio of the $B_{12}$-dependent dehydratase.

The screening step of the method further comprises the steps of:
a) growing a cell on a fermentable carbon substrate that does not include glycerol, wherein the cell does not have a source of coenzyme $B_{12}$, dehydratase reactivation factor, or $B_{12}$-independent dehydratase;
b) permeabilizing the cell;
c) adding a mixture of coenzyme $B_{12}$, glycerol, and at least 25 mM 1,3-propanediol to the permeabilized cell of step (b);
d) quantitating 3-hydroxypropionaldehyde produced in step (c), wherein the quantitating is a measurement selected from the group consisting of T1, T2, and T(600).

The invention further includes a nucleic acid sequence encoding a $B_{12}$-dependent mutant dehydratase selected from the group consisting of SEQ ID Nos:40, 44, 48, 52, 56, 60, 64, 68, 72, 76, 80, 84, 88, 92, 96, 100, 104, 108, 112, 116, 120, 124, 128, 132, 136, 140, 143, 147, 151, 155, 159, 163, 167, 171, 175, 179, 182, 186, 189, 192, 195, 198, 201, 204, 208, 212, 215, 218, 221, 225, 229, 233, 237, 241, 245, 249, 253, 257, 261, 265, 269, 273, 277, 281, 285, 289, 293, 297, 301, 304, 307, 310, 313, 316, 319, 322, 325, 328, 331, 334, and 337. More preferred $B_{12}$-dependent mutant dehydratases encoded by the nucleic acid sequence are selected from the group consisting of: SEQ ID NO: 40, 44, 48, 52, 56, 60, 64, 68, 72, 76, 80, 84, 88, 92, 96, 100, 104, 108, 112, 116, 120, 124, 128, 132, 136, 140, 143, 147, 151, 155, 159, 163, 167, 171, 175, 179, 182, 186, 189, 192, 195, 198, 201, 204, 208, 212, 215, 218, 221, 225, 229, 233, 237, 241, 245, 249, 253, 257, 261, 265, 269, 273, 277, 281, 285, 289, 293, 297, 301, 304, 307, 310, 313, 316, 319, 322, 325, 328, 331, 334, and 337. More preferred nucleic acid sequences encoding a $B_{12}$-dependent mutant dehydratase comprise an α-β subunit fusion that are selected from the group consisting of SEQ ID NOs:140, 179, 186, 189, 192, 195, 198, 201, 212, 215, 218, 301, 304, 307, 310, 313, 316, 319, 322, 325, 328, 331, 334, and 337. Most preferred nucleic acid sequences encoding a $B_{12}$-dependent mutant dehydratase comprise an α-β subunit fusion selected from the group consisting of SEQ ID NOs: 313, 322, and 328.

The invention also includes the nucleic acid sequences, further comprising a linker sequence between the α and β subunits of the α-β subunit fusion, wherein the linker sequence is selected from the group consisting of SEQ ID NO:18 and SEQ ID NO:19.

The invention also includes a method for creating $B_{12}$-dependent dehydratase mutants having improved reaction kinetics, comprising:
a) contacting a $B_{12}$-dependent dehydratase holoenzyme comprising hotspot 1 or hotspot 2 with a mutating agent;
b) screening the mutants produced in step A) for improved $k_{cat}$ and/or stability; and
c) repeating steps a) and b).

7. An further method of the invention for identifying $B_{12}$-dependent dehydratase with improved reaction kinetics relative to a reference dehydratase comprises
a) contacting a dehydratase holoenzyme with 5-10 mM glycerol and/or 10-300 mM 1,3-propanediol;
b) measuring at least two time points in a high throughput assay sufficiently separated to estimate $k_{cat}$ and total enzyme turnover;
c) selecting $B_{12}$-dependent mutants having improved reaction kinetics relative to the reference dehydratase.

A still further method of the invention for identifying $B_{12}$-dependent dehydratase with improved reaction kinetics relative to a reference dehydratase comprises
a) contacting a dehydratase holoenzyme with 5-50 mM glycerol and >300 mM 1,3-propanediol;
b) measuring one time point in a high throughput assay sufficiently separated from T0 to estimate the total enzyme turnover number; and
c) selecting $B_{12}$-dependent mutants having improved reaction kinetics relative to the reference dehydratase.

BRIEF DESCRIPTION OF THE DRAWINGS AND SEQUENCE LISTING

FIG. 1 shows the time course of a typical GDH reaction, performed either in the presence of glycerol or in the presence of glycerol and 1,3-propanediol.

FIG. 2 graphically illustrates results of a typical follow-up assay as described in Example 6.

Figure 1:
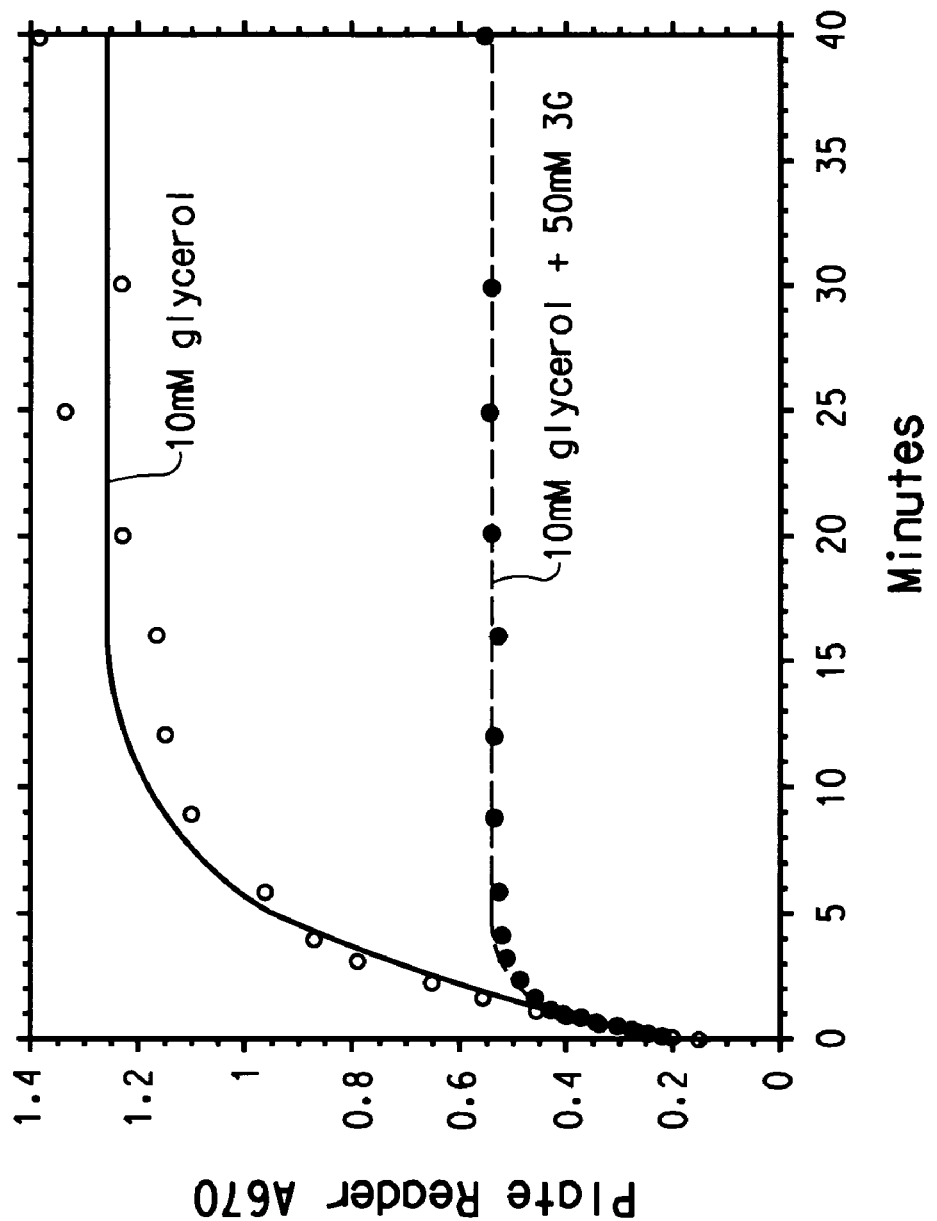

Applicants have provided 346 sequences in conformity with Rules for the Standard Representation of Nucleotide and Amino Acid Sequences in patent applications (Annexes I and II to the Decision of the President of the EPO, published in Supplement No. 2 to OJ EPO, 12/1992), with 37 C.F.R. 1.821-1.825 and Appendices A and B (Requirements for Application Disclosures Containing Nucleotides and/or Amino Acid Sequences) with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The Sequence Descriptions contain the one letter code for nucleotide sequence characters and the three letter codes for amino acids as defined in conformity with the IUPAC-IYUB standards described in *Nucleic Acids Research* 13:3021-3030 (1985) and in the *Biochemical Journal* 219 (2):345-373 (1984), which are herein incorporated by reference.

SEQ ID NO:1 is a 12.1 kB EcoRI-SalI fragment containing the wild-type GDH isolated from *Klebsiella pneumoniae* ATCC 25955 (Emptage et al., WO 01/012833 A2). The wild-type GDH is encoded by the α-subunit (bp 7044-8711), the α-subunit (bp 8724-9308), and the γ-subunit (bp 9311-9736). The amino acid sequences of the α, β, and γ-subunits of GDH are provided as SEQ ID NO:2, SEQ ID NO:3, and SEQ ID NO:4, respectively.

SEQ ID NOs: 5 and 6 encode primers DHA-F1 and DHA-R1, respectively, used for cloning GDH from plasmid pGH20.

SEQ ID NO: 7 encodes reverse primer DHA-R2, utilized for cloning the entire α- and a portion of the β-subunit of GDH.

SEQ ID NOs: 8-14 encode primers pGD20RM-F1, pGD20RM-R1, TB4BF, TB4BR, pGD20RM-F2, pGD20RM-R2, and GD-C respectively, used for regional random mutagensis of the α-subunit.

SEQ ID NOs: 15-17 encode degenerate primers pGD20RM-F3, TB4B-R1, and pGD20RM-R4, respectively, used for preparation of the regional random mutant libraries.

SEQ ID NO: 18 encodes the linker between the α- and β-subunits of fusion protein Sma3002. SEQ ID NO: 19 encodes the linker between the α- and β-subunits of fusion protein Xba3009.

SEQ ID NOs: 20-25 encode primers 2-F4-F1, 2-F4-R1, 12-B1-F1, 12-B1-R1, 16-H5-F1, and 16-H5-R1, respectively, utilized for synthesis of second generation mutant GDHs.

SEQ ID NOs: 26-29 encode primers 1-E1-F1, 1-E1-R1, 22-G7-F1, and 22-G7-R1, respectively, used for creating the pure fusion mutants 1-E1 and 22-G7.

SEQ ID NOs: 30-39 encode primers 7A-C1-F1, 7A-C1-R1, 7C-A5-F1, 7C-A5-R1, 8-C9-F1, 8-C9-R1, 9-D7-F1, 9-D7-R1, 10-G6-F1, and 10-G6-R1, respectively, used for synthesis of Sma3002-derived mutants.

Mutant enzymes derived from the wild-type GDH are assigned the following SEQ ID NOs, according to their respective nucleic acid sequences and amino acid sequences (Table 1):

TABLE 1

Full Length Mutant GDHs and their Respective SEQ ID NOs

| Strain | Mutagenesis Method Used to Create | Nucleic Acid SEQ ID NO | Amino Acid SEQ ID NO |
|---|---|---|---|
| Xba3007 | 1st Round Random | 40 | 41, 42, 43 |
| Xba3029 | 1st Round Random | 44 | 45, 46, 47 |
| Xba3004 | 1st Round Random | 48 | 49, 50, 51 |
| Xba3025 | 1st Round Random | 52 | 53, 54, 55 |
| Xba3038 | 1st Round Random | 56 | 57, 58, 59 |
| Xba3030 | 1st Round Random | 60 | 61, 62, 63 |
| Xba3006 | 1st Round Random | 64 | 65, 66, 67 |
| Xba3031 | 1st Round Random | 68 | 69, 70, 71 |
| Xba3017 | 1st Round Random | 72 | 73, 74, 75 |
| Xba3005 | 1st Round Random | 76 | 77, 78, 79 |
| Xba3033 | 1st Round Random | 80 | 81, 82, 83 |
| Xba3032 | 1st Round Random | 84 | 85, 86, 87 |
| Xba3018 | 1st Round Random | 88 | 89, 90, 91 |
| Xba3014 | 1st Round Random | 92 | 93, 94, 95 |
| Xba3024 | 1st Round Random | 96 | 97, 98, 99 |
| Xba3026 | 1st Round Random | 100 | 101, 102, 103 |
| Sma3009 | 1st Round Random | 104 | 105, 106, 107 |
| Sma3010 | 1st Round Random | 108 | 109, 110, 111 |
| Sma3014 | 1st Round Random | 112 | 113, 114, 115 |
| Sma3008 | 1st Round Random | 116 | 117, 118, 119 |
| Sma3001 | 1st Round Random | 120 | 121, 122, 123 |
| PpuMI001 | 1st Round Regional Random | 124 | 125, 126, 127 |
| PpuMI002 | 1st Round Regional Random | 128 | 129, 130, 131 |
| PpuMI005 | 1st Round Regional Random | 132 | 133, 134, 135 |
| RsrII001 | 1st Round Regional Random | 136 | 137, 138, 139 |
| Sma3002 | 1st Round Random | 140 | 141, 142 |
| Sma3003 | 1st Round Random | 143 | 144, 145, 146 |
| Xba3015 | 1st Round Random | 147 | 148, 149, 150 |
| Xba3008 | 1st Round Random | 151 | 152, 153, 154 |
| Xba3016 | 1st Round Random | 155 | 156, 157, 158 |
| Xba3020 | 1st Round Random | 159 | 160, 161, 162 |
| Xba3037 | 1st Round Random | 163 | 164, 165, 166 |
| Xba3036 | 1st Round Random | 167 | 168, 169, 170 |
| 4BR1001 | 1st Round Regional Random | 171 | 172, 173, 174 |
| Xba3010 | 1st Round Random | 175 | 176, 177, 178 |
| Xba3009 | 1st Round Random | 179 | 180, 181 |
| Xba3023 | 1st Round Random | 182 | 183, 184, 185 |
| 2-F4 | 2nd Round Rationale Design | 186 | 187, 188 |
| 12-B1 | 2nd Round Rationale Design | 189 | 190, 191 |
| 13-B7 | 2nd Round Rationale Design | 192 | 193, 194 |
| 16-H5 | 2nd Round Rationale Design | 195 | 196, 197 |
| 1-E1 | 2nd Round Rationale Design | 198 | 199, 200 |
| 22-G7 | 2nd Round Rationale Design | 201 | 202, 203 |
| 7A-C1 | 2nd Round Rationale Design | 204 | 205, 206, 207 |
| 7C-A5 | 2nd Round Rationale Design | 208 | 209, 210, 211 |
| 8-C9 | 2nd Round Rationale Design | 212 | 213, 214 |
| 9-D7 | 2nd Round Rationale Design | 215 | 216, 217 |
| 10-G6 | 2nd Round Rationale Design | 218 | 219, 220 |
| 21-D10 | 3rd Round Rationale Design | 221 | 222, 223, 224 |
| 20-B9 | 3rd Round Rationale Design | 225 | 226, 227, 228 |
| 18-D7 | 3rd Round Rationale Design | 229 | 230, 231, 232 |
| 17-F6 | 3rd Round Rationale Design | 233 | 234, 235, 236 |
| 15-E4 | 3rd Round Rationale Design | 237 | 238, 239, 240 |
| KG002 | 1st Round Random | 241 | 242, 243, 344 |
| KG003 | 1st Round Random | 245 | 246, 247, 248 |
| KG004 | 1st Round Random | 249 | 250, 251, 252 |
| KG005 | 1st Round Random | 253 | 254, 255, 256 |
| KG006 | 1st Round Random | 257 | 258, 259, 260 |
| KG007 | 1st Round Random | 261 | 262, 263, 264 |
| KG010 | 1st Round Random | 265 | 266, 267, 268 |
| KG011 | 1st Round Random | 269 | 270, 271, 272 |
| KG012 | 1st Round Random | 273 | 274, 275, 276 |
| KG014 | 1st Round Random | 277 | 278, 279, 280 |
| KG016 | 1st Round Random | 281 | 282, 283, 284 |
| KG017 | 1st Round Random | 285 | 286, 287, 288 |
| KG021 | 1st Round Random | 289 | 290, 291, 292 |
| KG023 | 1st Round Random | 293 | 294, 295, 296 |
| KG001 | 1st Round Random | 297 | 298, 299, 300 |
| GDH-SM1-G11 | Site-saturation | 301 | 302, 303 |
| GDH-SM2-B11 | Site-saturation | 304 | 305, 306 |
| GDH-SM3-D2 | Site-saturation | 307 | 308, 309 |
| GDH-SM4-H2 | Site-saturation | 310 | 311, 312 |
| SHGDH37 | Unpaired Primers | 313 | 314, 315 |
| SHGDH51 | Unpaired Primers | 316 | 317, 318 |
| SHGDH12 | Unpaired Primers | 319 | 320, 321 |
| SHGDH22 | Unpaired Primers | 322 | 323, 324 |
| SHGDH38 | Unpaired Primers | 325 | 326, 327 |
| SHGDH24 | Unpaired Primers | 328 | 329, 330 |
| SHGDH43 | Unpaired Primers | 331 | 332, 333 |
| SHGDH25 | Unpaired Primers | 334 | 335, 336 |
| SHGDH29 | Unpaired Primers | 337 | 338, 339 |

SEQ ID NOS:340-342 encode the primers T53-SM, L509-SM, and V224-SM, respectively.

SEQ ID Nos:343 and 344 encode the primers GDHM-F1 and GDHM-R1, respectively.

SEQ ID Nos:345 and 346 encode the primers GDHM-F2 and GDHM-R2, respectively.

DETAILED DESCRIPTION OF THE INVENTION

The Applicants have solved the stated problem by providing engineered coenzyme $B_{12}$-dependent dehydratases with improved reaction kinetics (i.e., providing an increased total turnover number in the presence of glycerol and 1,3-propanediol) for use in industrial applications, specifically for producing 3-hydroxypropionaldehyde and 1,3-propanediol. Created by techniques of mutagenesis, these dehydratases are characterized by either having an increased $k_{cat}$ and/or a decreased rate of enzyme inactivation, relative to the wild-type enzyme from which they were created.

The engineered coenzyme $B_{12}$-dependent dehydratases of the invention reduce the rate of inactivation without undue sacrifice to the rate of catalysis. This solution to the problem of dehydratase inactivation is preferred since it increases the turnover ratio (mol product/mol holoenzyme) of coenzyme $B_{12}$-dependent dehydratase in the microbial host. The effect of increased turnover ratio reduces the dehydratase demand, the coenzyme $B_{12}$ demand, and the energetic consumption to maintain that level of dehydratase and coenzyme $B_{12}$. In addition, coenzyme $B_{12}$-dependent dehydratases have been demonstrated to operate efficiently for the production of 1,3-propanediol under industrial process conditions.

In addition to providing a suite of mutant dehydratases, the present invention also provides two high throughput assays to facilitate screening of mutant dehydratases. Both methods rely on the existence of the $B_{12}$-dependent dehydratase in its apoenzyme form in cells that do not have a source of the coenzyme $B_{12}$, dehydratase reactivation factor, or $B_{12}$-independent dehydratase. Thus, it is possible to precisely control the initiation of dehydratase activity, based on the addition of coenzyme $B_{12}$ and substrate glycerol.

Specifically, large libraries of mutated coenzyme $B_{12}$-dependent dehydratase genes were generated and the gene products expressed and screened in high thoughput fashion for reduced inactivation in the presence of a glycerol and 1,3-propandiol mixture. The screening method enabled the facile and rapid identification of those engineered coenzyme $B_{12}$-dependent dehydratases with reduced inactivation rates and improved rates of glycerol catalysis. Subsequent rounds of dehydratase engineering enabled the generation and identification of even more improved dehydratase varients.

It will be obvious to one of skill in the art, based on the teachings herein, that a variety of genes encoding $B_{12}$-dependent dehydratase activity capable of catalyzing the conversion of glycerol to 3-HP should be suitable as a target for mutagenesis and screening, as described in the present invention. Thus, it will be expected that a variety of mutant dehydratases having improved reaction kinetics (i.e., an increased total turnover number in the presence of glycerol and 1,3-propanediol) could be identified by means of this invention.

DEFINITIONS

The following abbreviations and definitions are used for the interpretation of the specification and the claims.

"Polymerase chain reaction" is abbreviated PCR.

"3-Hydroxypropionaldehyde" is abbreviated 3-HP.

The term "dehydratase" is used to refer to any enzyme that is capable of isomerizing or converting a glycerol molecule to the product 3-hydroxypropionaldehyde. As noted above, some dehydratases require coenzyme $B_{12}$ as a cofactor. The terms "coenzyme $B_{12}$-dependent dehydratase" and "$B_{12}$-dependent dehydratase" are used interchangeably to refer to those dehydratases which require coenzyme $B_{12}$. Coenzyme $B_{12}$-dependent dehydratase comprise the coenzyme $B_{12}$-dependent dehydratase (E.C. 4.2.1.30) and the coenzyme $B_{12}$-dependent dehydratase (E.C. 4.2.1.28). Alternatively, dehydratases may be coenzyme $B_{12}$-independent; these enzymes do not require coenzyme $B_{12}$ as cofactor and are referred to by the term "$B_{12}$-independent dehydratase". For the purposes of this invention, the term "glycerol dehydratase" are used to specifically refer to the coenzyme $B_{12}$-dependent dehydratase (E.C. 4.2.1.30) and the term "diol dehydratase" are used to specifically refer to the coenzyme $B_{12}$-dependent dehydratase (E.C. 4.2.1.28). (Applicants' deliberate choice of nomenclature is not to be confused with that of Hartmanis and Stadman, supra and Crous et al., supra who refer to $B_{12}$-independent dehydratases by the terms "diol dehydratase" and "glycerol dehydratase", respectively.)

The term "apoenzyme" refers to the portion of an enzyme that is composed of protein. An apoenzyme does not include non-protein structures that may be required for the enzyme to be functional; and thus, an apoenzyme may be catalytically inactive. The term "cofactor" refers to a non-protein structure that is required by an apoenzyme for catalytic activity. The term "holoenzyme" refers to the catalytically active protein-cofactor complex. A coenzyme $B_{12}$-dependent dehydratase apoenzyme requires the cofactor coenzyme $B_{12}$ to form holoenzyme.

The terms "coenzyme $B_{12}$" and "adenosylcobalamin" are used interchangeably to mean 5'-deoxyadenosylcobalamin.

The terms "vitamin $B_{12}$" and "cyanocobalamin" are used interchangeably and refer to the derivative of coenzyme $B_{12}$ where the upper axial 5'-deoxy-5'-adenosyl ligand is replaced with a cyano moiety.

"Hydroxocobalamin" refers to a derivative of coenzyme $B_{12}$ wherein the upper axial 5'-deoxyadenosyl ligand is replaced with a hydroxy moiety. Aquacobalamin is the protonated form of hydroxocobalamin.

Inactivation of a $B_{12}$-independent dehydratase holoenzyme by glycerol or 1,3-propanediol leads to the formation of an inactive cobalamin species which has lost the upper axial 5'-deoxy-5'-adenosyl ligand. The term "coenzyme $B_{12}$ precursor" refers to a derivation of coenzyme $B_{12}$ where the upper axial 5'-deoxyadenosyl ligand is replaced.

As used herein, the term "GDH" refers specifically to the $B_{12}$-dependent, glycerol dehydratase isolated from *Klebsiella pneumoniae* ATCC 25955 and encoded by bp 7044-8711, bp 8724-9308, and bp 9311-9736 of SEQ ID NO:1. The term "GDH" is used to refer to the assembled complex of α, β, and γ-subunits and may refer to apoenzyme or holoenzyme. Reference to an individual subunit of GDH will specify the subunit, for example "α-subunit of GDH" or "GDH α-subunit". Similarly, reference may be made to the amino acid sequence of GDH, referring collectively to the α- and the ⊖- and the γ-subunits; or, to an individual subunit of GDH. The amino acid sequences of the α, β, and γ-subunits of GDH are provided as SEQ ID NO:2, SEQ ID NO:3, and SEQ ID NO:4, respectively.

For purposes of this invention disclosure, GDH is used as a reference for DNA and amino acid sequence as compared to engineered (mutant) derivatives. GDH is also used as a reference for wild-type reaction kinetics against which the reaction kinetics of the engineered derivatives created by use of the invention are measured. While GDH is used as the reference material herein, any naturally occurring coenzyme $B_{12}$-dependent dehydratase (e.g., those listed in Table 2) could be used interchangeably with GDH in the present invention against which the reaction kinetics of engineered derivatives are measured.

The term "genetically altered" refers to the process of changing hereditary material by transformation or mutation.

As used herein, the term "mutant" refers to a bacterial clone, plasmid, library or vector containing a GDH enzyme or a GDH sequence that has been generated by a process of mutation. Alternatively, the term mutant refers directly to a GDH enzyme, GDH amino acid sequence, or GDH DNA sequence that has been generated by a process of mutation. Thus, the mutant GDH is different than the (wild-type) GDH.

The term "improved reaction kinetics" refers to a reduced rate of dehydratase inactivation in the presence of glycerol and/or 1,3-propanediol, with respect to the wildtype enzyme. Thus, improved reaction kinetics are related to an increased total enzyme turnover number in the presence of glycerol and 1,3-propanediol. This can be achieved by either increasing the $k_{cat}$ and/or decreasing the rate of enzyme inactivation.

The term "catalytic efficiency" is defined as the $k_{cat}/K_M$ of an enzyme. "Catalytic efficiency" is used to quantitate the specificity of an enzyme for a substrate.

The terms "$k_{cat}$", "$K_M$", and "$K_i$" are known to those skilled in the art and are described in (Ferst In Enzyme Structure and Mechanism, $2^{nd}$ ed.; W.H. Freeman: New York, 1985; pp 98-120).

The term "$k_{cat}$" is often called the "turnover number". The term "$k_{cat}$" is defined as the maximum number of substrate molecules converted to products per active site per unit time, or the number of times the enzyme turns over per unit time. $k_{cat}=V_{max}/[E]$, where [E] is the enzyme concentration (Ferst In Enzyme Structure and Mechanism, 2nd ed.; W.H. Freeman: New York, 1985; pp 98-120). The terms "total turnover" and "total turnover number" are used herein to refer to the amount of product formed by the reaction of a $B_{12}$-dependent dehydratase holoenzyme with glycerol (optionally, in the presence of 1,3-propanediol) in the time period between initiation of the reaction ($T_0$) and that time where complete inactivation of the holoenzyme has occurred.

The term "$K_i$" refers to the inhibition constant of 1,3-propanediol.

The term "$k_{inact\ obsd}$" refers to the first order rate constant of inactivation observed in the reaction of a $B_{12}$-dependent dehydratase holoenzyme and excess glycerol and/or excess 1,3-propanediol. In the presence of excess glycerol alone, $k_{inact\ obsd}$ is equal to $k_{inact\ glycerol}$. In the presence of excess 1,3-propanediol alone, $k_{inact\ obsd}$ is equal to $k_{inact\ 1,3\text{-}propanediol}$. In the presence of both excess glycerol and excess 1,3-propanediol alone, $k_{inact\ obsd}$ is equal to a function of both $k_{inact\ glycerol}$ and $k_{inact\ 1,3\text{-}propanediol}$.

The term "T1" refers to the amount of product made by a GDH enzyme reaction measured at 30 sec after the reaction's initiation in the presence of 10 mM glycerol and 50 mM 1,3-propanediol. T1 is proportional to $k_{cat}$.

The term "T2" refers to the amount of product made by a GDH enzyme reaction measured at 40 min after the reaction's initiation in the presence of 10 mM glycerol and 50 mM 1,3-propanediol. T2 is proportional to $k_{cat}/k_{inact\ obsd}$, reflecting the total enzyme total turnover number.

The term "T2/T1 ratio" refers to the ratio of T2 to T1. The T2/T1 ratio is proportional to $1/k_{inact\ obsd}$.

The term "T2(600)" refers to the amount of product made by a GDH enzyme reaction measured at 40 min after the reaction's initiation in the presence of 10 mM glycerol and 600 mM 1,3-propanediol. T2(600) is proportional to $k_{cat}/k_{inact\ obsd}$, reflecting the total enzyme total turnover number in the presence of 600 mM 1,3-propanediol.

The term "T(600)" refers to the amount of product made by a GDH enzyme reaction measured at 70 min after the reaction's initiation in the presence of 10 mM glycerol and 600 mM 1,3-propanediol. T(600) is proportional to $k_{cat}/k_{inact\ obsd}$. T(600) value gives a more accurate total enzyme turnover number in the presence of 600 mM 1,3-propanediol than the T2(600).

The terms "polypeptide" and "protein" are used interchangeably.

The terms "host cell" or "host organism" refer to a microorganism capable of receiving foreign or heterologous genes and of expressing those genes to produce an active gene product.

The term "isolated" refers to a protein or DNA sequence that is removed from at least one component with which it is naturally associated.

An "isolated nucleic acid molecule" is a polymer of RNA or DNA that is single- or double-stranded, optionally containing synthetic, non-natural or altered nucleotide bases. An isolated nucleic acid molecule in the form of a polymer of DNA may be comprised of one or more segments of cDNA, genomic DNA or synthetic DNA.

"Gene" refers to a nucleic acid fragment that expresses a specific protein, and optionally may include regulatory sequences preceding (5' non-coding sequences) and following (3' non-coding sequences) the coding sequence. "Native gene" and "wild-type gene" refer to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is instead introduced into the host organism by gene transfer. Foreign genes can comprise native genes inserted into a non-native organism, or chimeric genes. A "transgene" is a gene that has been introduced into the genome by a transformation procedure.

The terms "encoding" and "coding" refer to the process by which a gene, through the mechanisms of transcription and translation, produces an amino acid sequence. It is understood that the process of encoding a specific amino acid sequence includes DNA sequences that may involve base changes that do not cause a change in the encoded amino acid, or which involve base changes which may alter one or more amino acids, but do not affect the functional properties of the protein encoded by the DNA sequence. It is therefore understood that the invention encompasses more than the specific exemplary sequences.

The term "amino acid" refers to the basic chemical structural unit of a protein or polypeptide. The amino acids are identified by either one-letter code or the three-letter codes for amino acids, in conformity with the IUPAC-IYUB standards described in Nucleic Acids Research 13:3021-3030 (1985) and in the Biochemical Journal 219 (2):345-373 (1984), which are herein incorporated by reference.

For a particular protein, point substitution mutations within the DNA coding region and the resulting amino acid change are specified with reference to a standard DNA and amino acid sequence, using one of the following notations. For example, in the case of mutations in GDH, the mutations are described using one of the notations described below:

1. A detailed notation: First, the nucleotide sequence for the wild-type codon is presented; followed by an "α", "β", or "γ" symbol (to distinguish mutations in the α, β-, or γ-subunit of GDH), the specific wild-type amino acid in three-letter abbreviation, and its position. The wild-type information is then followed by the specific nucleotide and amino acid modification that exist in the referenced mutation. An example of this notation is: GGG (α-Gly63) to GGA(Gly), wherein the $63^{rd}$ codon of the α-subunit underwent a silent mutation such that the nucleotide sequence was altered from "GGG" to "GGA" in the mutant.

2. A "short-hand" notation: An "α", "β", or "γ" symbol (to distinguish mutations in the α- β- or γ-subunit of GDH) is followed by the wild-type amino acid in one-letter abbreviation, the codon position, and the one-letter abbreviation for the mutant amino acid. An example of this notation is: α-V224L, representing the mutation of the wild-type valine at codon 224 in the α-subunit to'leucine in the mutant.

It is well known in the art that alterations in a gene which result in the production of a chemically equivalent amino acid at a given site (but do not effect the functional properties of the encoded protein) are common.

"Substantially similar" refers to nucleic acid molecules wherein changes in one or more nucleotide bases result in substitution of one or more amino acids, but do not affect the functional properties of the protein encoded by the DNA sequence. "Substantially similar" also refers to nucleic acid molecules wherein changes in one or more nucleotide bases do not affect the ability of the nucleic acid molecule to mediate alteration of gene expression by antisense or co-suppression technology. "Substantially similar" also refers to modifications of the nucleic acid molecules of the instant invention (such as deletion or insertion of one or more nucleotide bases) that do not substantially affect the functional properties of the resulting transcript vis-à-vis the ability to mediate alteration of gene expression by antisense or co-suppression technology or alteration of the functional properties of the resulting protein molecule. The invention encompasses more than the specific exemplary sequences.

Each of the proposed modifications is well within the routine skill in the art, as is determination of retention of biological activity of the encoded products. Moreover, the skilled artisan recognizes that substantially similar sequences encompassed by this invention are also defined by their ability to hybridize, under stringent conditions (0.1×SSC, 0.1% SDS, 65° C. and washed with 2×SSC, 0.1% SDS followed by 0.1×SSC, 0.1% SDS), with the sequences exemplified herein. Preferred substantially similar nucleic acid fragments of the instant invention are those nucleic acid fragments whose DNA sequences are at least 80% identical to the DNA sequence of the nucleic acid fragments reported herein. More preferred nucleic acid fragments are at least 90% identical to the DNA sequence of the nucleic acid fragments reported herein. Most preferred are nucleic acid fragments that are at least 95% identical to the DNA sequence of the nucleic acid fragments reported herein.

A nucleic acid fragment is "hybridizable" to another nucleic acid fragment, such as a cDNA, genomic DNA, or RNA, when a single stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein.

A "substantial portion" refers to an amino acid or nucleotide sequence which comprises enough of the amino acid sequence of a polypeptide or the nucleotide sequence of a gene to afford putative identification of that polypeptide or gene, either by manual evaluation of the sequence by one skilled in the art, or by computer-automated sequence comparison and identification using algorithms such as BLAST (Basic Local Alignment Search Tool; Altschul et al., *J. Mol. Biol.* 215:403-410 (1993); see also www.ncbi.nlm.nih.gov/BLAST/). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene-specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic-acid molecule comprising the primers. Accordingly, a "substantial portion" of a nucleotide sequence comprises enough of the sequence to afford specific identification and/or isolation of a nucleic acid molecule comprising the sequence. The instant specification teaches partial or complete amino acid and nucleotide sequences encoding one or more particular proteins. The skilled artisan, having the benefit of the sequences as reported herein, may now use all or a substantial portion of the disclosed sequences for purposes known to those skilled in the art. Accordingly, the instant invention comprises the complete sequences as reported in the accompanying Sequence Listing, as well as substantial portions of those sequences as defined above.

The term "complementary" describes the relationship between double stranded DNA. For example, with respect to DNA, adenosine is complementary to thymine and cytosine is complementary to guanine. Accordingly, the instant invention also includes isolated nucleic acid molecules that are complementary to the complete sequences as reported in the accompanying Sequence Listing, as well as those substantially similar nucleic acid sequences.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology*, Lesk, A. M., Ed.; Oxford University: New York, 1988; 2.) *Biocomputing: Informatics and Genome Projects*; Smith, D. W., Ed.; Academic: New York, 1993; 3.) *Computer Analysis of Sequence Data, Part I*; Griffin, A. M. and Griffin, H. G., Eds.; Humana: New Jersey, 1994; 4.) *Sequence Analysis in Molecular Biology*; von Heinje, G., Ed.; Academic: New York, 1987; and 5.) *Sequence Analysis Primer*, Gribskov, M. and Devereux, J., Eds.; Stockton: New York, 1991. Preferred methods to determine identity are designed to give the largest match between the sequences tested.

Methods to determine identity and similarity are codified in publicly available computer programs. Preferred computer program methods to determine identity and similarity between two sequences include, but are not limited to: the GCG Pileup program found in the GCG program package, using the Needleman and Wunsch algorithm with their standard default values of gap creation penalty=12 and gap extension penalty=4 (Devereux et al., *Nucleic Acids Res.* 12:387-395 (1984)), BLASTP, BLASTN, and FASTA (Pearson et al., *Proc. Natl. Acad. Sci. USA* 85:2444-2448 (1988)). The BLASTX program is publicly available from NCBI and other sources (*BLAST Manual*, Altschul et al., Natl. Cent. Biotechnol. Inf., Natl. Library Med. (NCBI NLM) NIH, Bethesda, Md.; Altschul et al., *J. Mol. Biol.* 215:403-410 (1990); Altschul et al., *Nucleic Acids Res.* 25:3389-3402 (1997)). Another preferred method to determine percent identity is by the method of the DNASTAR protein alignment protocol using the Jotun-Hein algorithm (Hein et al., *Methods Enzymol.* 183:626-645 (1990)). Default parameters for the Jotun-Hein method for alignments are: 1.) for multiple alignments: gap penalty=11, gap length penalty=3; and 2.) for pairwise alignments: ktuple=6. As an illustration, by a polynucleotide having a nucleotide sequence having at least, for example, 95% "identity" to a reference nucleotide sequence it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5' or 3' terminal positions of the reference nucleotide sequence or anywhere between is those terminal positions, interspersed either individually among nucleotides in the reference sequence or in one or more contiguous groups within the reference sequence. Analogously, by a polypeptide having an amino acid sequence having at least, for example, 95% identity to a reference amino acid sequence is intended that the amino acid sequence of the polypeptide is identical to the reference sequence except that the polypeptide sequence may include up to five amino acid alterations per each 100 amino acids of the reference amino acid. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

The term "homologous" refers to a protein or polypeptide native or naturally occurring in a given host cell. The invention includes microorganisms producing homologous proteins via recombinant DNA technology.

The term "percent homology" refers to the extent of amino acid sequence identity between polypeptides. When a first amino acid sequence is identical to a second amino acid sequence, then the first and second amino acid sequences exhibit 100% homology. The homology between any two polypeptides is a direct function of the total number of matching amino acids at a given position in either sequence, e.g., if half of the total number of amino acids in either of the two sequences are the same then the two sequences are said to exhibit 50% homology.

"Codon degeneracy" refers to divergence in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid.

Modifications to the sequence, such as deletions, insertions, or substitutions in the sequence which produce silent changes that do not substantially affect the functional properties of the resulting protein molecule are also contemplated. For example, alteration in the gene sequence which reflect the degeneracy of the genetic code, or which result in the production of a chemically equivalent amino acid at a given site, are contemplated. In some cases, it may in fact be desirable to make mutants of the sequence in order to study the effect of alteration on the biological activity of the protein. Each of the proposed modifications is well within the routine skill in the art, as is determination of retention of biological activity in the encoded products.

The term "expression" refers to the transcription and translation to gene product from a gene coding for the sequence of the gene product.

The terms "plasmid", "vector", and "cassette" refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The term "recombination" will refer to a process whereby genetic combinations are formed which were not present in parental template molecules, by the processes of crossing over or independent assortment. Thus, recombination includes all combinations of genetic sequences that can be obtained from the parental template molecules (whereby each nucleotide position of the newly generated "recombinogenic product(s)" can be derived from any of the parental templates at that particular nucleotide position); and additionally, recombination includes the introduction of new mutations (i.e., deletions, substitutions, insertions).

The term "recombined polypeptide" means a polypeptide encoded by recombined genes or DNA. Recombined polypeptides will often have altered or enhanced properties.

The term "altered properties" as applied to a polypeptide or protein will refer to a characteristic, associated with a protein encoded by a nucleotide sequence which can be measured by an assay method, where that characteristic is either enhanced or diminished compared with that associated with the native sequence. Examples of preferred properties of an enzyme that may be altered include the enzyme's activity, substrate specificity, stability against inhibitors, thermal stability, protease stability, solvent stability, detergent stability, and folding properties. "Enhanced biological property" refers to an altered property that is greater than that associated with the native sequence. "Diminished biological properties" is an altered property that is less than that associated with the native sequence.

The term "template(s)" or "parent template(s)" refers to a nucleic acid molecule that is copied by a DNA or RNA polymerase according to the rules of Watson-Crick base pairing to produce a new strand of DNA or RNA. The sequence information in the template (or "model") is preserved, since the first copy produced from that template molecule has a complementary sequence. Template molecules may be single or double-stranded and derived from any source.

"Replication" is the process in which a complementary copy of a nucleic acid strand of the "template nucleic acid" is synthesized by a polymerase enzyme. In a "primer-directed" replication, this process requires a hydroxyl group (OH) at the 3' position of a (deoxy)ribose moiety of the terminal nucleotide of a "duplexed" "oligonucleotide" to initiate replication.

The "5' region" and "3' region" of a nucleic acid will be used as relative terms, in reference to the region of nucleotides wherein it is desirable for recombination to occur. These regions may be within a template molecule or within a flanking DNA sequence that is attached to the template molecules. Unpaired primers will anneal to a portion of these 5' and 3' regions.

A "flanking sequence" or "flanking DNA fragment" will refer to a short segment of DNA that is attached to either the 5' or 3' region of a template molecule, in order to provide a unique nucleotide sequence (with respect to the template molecule) to which an unpaired primer may anneal.

A "full length extension product" is a nucleotide sequence produced by primer-directed replication that has a length very similar (within about 100 bases) to that contained between the 5' and 3' region of the parent templates.

"Amplification" is the process in which replication is repeated in cyclic manner such that the number of copies of the "template nucleic acid" is increased in either a linear or logarithmic fashion.

The term "primer" refers to an oligonucleotide (synthetic or occurring naturally), which is capable of acting as a point of initiation of nucleic acid synthesis or replication along a complementary strand when placed under conditions in which synthesis of a complementary stand is catalyzed by a polymerase. The primer must have the ability to anneal to the complementary strand, based on sequence complementarity between the primer itself and the complementary strand of nucleic acid, however some mismatch in bases is tolerated. Requirements for primer size, base sequence, complementarity and target interaction are discussed in greater detail below. The term "primer", as such, is used generally herein by Applicants to encompass any sequence-binding oligonucleotide which functions to initiate the nucleic acid replication process (i.e., is capable of priming synthesis).

The term "forward primer" will refer to a primer that is capable of priming synthesis at the 5' region on a sense strand of a double-stranded template molecule or that is capable of priming synthesis at the 5' region of a single-stranded template molecule.

The term "reverse primer" will refer to a primer that is capable of priming synthesis at the 5' region on an antisense strand of a double-stranded template molecule or that is capable of priming synthesis at the 5' region of a single-stranded template molecule that is an antisense strand of a double-stranded template molecule.

The term "paired primers" will refer to a pair of primers, consisting of a forward and reverse primer, which are designed to anneal to a single template molecule and permit synthesis of an exact copy of that template by a primer directed nucleic acid amplification process. In the case of a double-stranded template molecule, the forward and reverse primers enable the synthesis of an exact copy of the double-stranded template since the forward primer produces an exact copy of the antisense strand (that is a complementary copy of the sense strand which it is using as a template) and the reverse primer produces an exact copy of the sense strand (that is a complementary copy of the antisense strand which it is using as a template). In contrast, when the template molecule is single-stranded, an exact copy of that template is produced using a primer directed nucleic acid amplification process.

The term "unpaired primers" will refer to a pair of primers, consisting of a forward and reverse primer, which are not designed to anneal to a single template molecule and permit synthesis of an exact copy of that template by a primer directed nucleic acid amplification process. Instead, the forward primer will anneal to a first template molecule, but will not be able to anneal to a second template molecule. The reverse primer will anneal to a second template molecule that is different in sequence from the first template molecule, and yet will not be able to anneal to the first template molecule. This unique design of unpaired primers ensures that a single- or double-stranded template molecule can not be amplified by a primer directed nucleic acid amplification process, unless recombination occurs during replication via template switching.

The term "primer directed extension" refers to any method known in the art wherein primers are used to sponsor replication of nucleic acid sequences in the linear or logarithmic amplification of nucleic acid molecules. For example, primer-directed extension may be accomplished by any of several schemes known in the art including, but not limited to: the polymerase chain reaction (PCR), ligase chain reaction (LCR), and strand-displacement amplification (SDA).

GDH and the Encoding Genes

With respect to the conversion of glycerol to 3-HP, the dehydratase responsible for catalyzing this reaction can be a $B_{12}$-dependent dehydratase or a $B_{12}$-independent dehydratase. For the purposes of this invention, however, the dehydratase is a $B_{12}$-dependent dehydratase. This $B_{12}$-dependent dehydratase can be GDH, a glycerol dehydratase (E.C. 4.2.1.30), or a diol dehydratase (E.C. 4.2.1.28). Each of these enzymes possess an $\alpha_2\beta_2\gamma_2$ structure. For clarity, due to the wide variation in gene nomenclature used in the literature, a comparative chart showing gene names and GenBank references for dehydratase genes of *Klebsiella pneumoniae, Citrobacter freundii, Clostridium pasteurianum, Salmonella typhimurium, Lactobacillus collinoide*, and *Klebsiella oxytoca* are given in TABLE 2 to facilitate identification. The genes are also described in, for example, Daniel et al. (*FEMS Microbiol. Rev.* 22: 553 (1999)) and Toraya and Mori (*J. Biol. Chem.* 274: 3372 (1999)).

TABLE 2

Comparative chart of gene names and GenBank references for dehydratases

| ORGANISM | dehydratase, α | | dehydratase, β | | dehydratase, γ | |
|---|---|---|---|---|---|---|
| (GenBank Reference) | gene | bp | gene | bp | gene | bp |
| *K. pneumoniae* (WO 01/012833A2) (SEQ ID NO:1) | dhaB1 | 7044-8711 | dhaB2 | 8724-9308 | dhaB3 | 9311-9736 |
| *K. pneumoniae* (U30903) | DhaB1 | 3047-4714 | dhaB2 | 2450-2890 | dhaB3 | 2022-2447 |
| *K. pneumoniae* (U60992) | gldA | 121-1788 | gldB | 1801-2385 | gldC | 2388-2813 |
| *C. freundii* (U09771) | dhaB | 8556-10223 | dhaC | 10235-10819 | dhaE | 10822-11250 |
| *C. pasteurianum* (AF051373) | dhaB | 84-1748 | dhaC | 1779-2318 | dhaE | 2333-2773 |
| *S. typhimurium* (AF026270) | pduC | 3557-5221 | pduD | 5232-5906 | pduE | 5921-6442 |
| *L. collinoides* (AJ297723) | pduC | 2480-4156 | pduD | 4185-4877 | pduE | 4897-5418 |
| *K. oxytoca* (AF051373) | pddA | 121-1785 | pddB | 1796-2470 | pddC | 2485-3006 |

For the purposes of the present invention, GDH encoded by dhaB1, dhaB2, and dhaB3 (SEQ ID NO:1 and SEQ ID NO: 2, 3, and 4, respectively) of *K. pneumoniae* (WO 01/012833A2) was used as the target for mutagenesis. This enzyme, a glycerol dehydratase, has a preferred substrate of glycerol and is known to consist of two 63 kDa α subunits, two 21 kDa β subunits, and two 16 kDa γ subunits. However, one skilled in the art will recognize that glycerol dehydratases of *Citrobacter freundii*, *Clostridium pasteurianum*, or other *K. pneumoniae* strains; or, diol dehydratase of *Salmonella typhimurium*, *Klebsiella oxytoca* or *K. pneumoniae* will also be suitable for the techniques described herein. Likewise, any gene(s) encoding a $B_{12}$-dependent dehydratase activity wherein that activity is capable of catalyzing the conversion of glycerol to 3-HP should be suitable as a target in the present invention, including any amino acid sequence that encompasses amino acid substitutions, deletions or additions that do not alter the function of GDH enzyme. Thus, the skilled person will appreciate that genes encoding GDH isolated from other sources will also be suitable for use in the present invention.

$B_{12}$-Dependent Dehydratase Inactivation in the Presence of Glycerol or 1,3-Propanediol $B_{12}$-dependent dehydratases undergo irreversible inactivation by glycerol during catalysis or by interaction with 1,3-propanediol. Inactivation involves cleavage of the cobalt-carbon (Co—C) bond of the coenzyme $B_{12}$ cofactor, leading to the formation of 5'-deoxyadenosine and an inactive cobalamin species. The inactive cobalamin species remains tightly bound to the dehydratase; dissociation does not occur without the intervention of coenzyme $B_{12}$-dependent dehydratase reactivation factors.

FIG. 1 illustrates the typical time course associated with GDH inactivation. These enzyme activity assays were conducted using the GDH encoded by dhaB1, dhaB2, and dhaB3 (SEQ ID NO:1 and SEQ ID NO: 2, 3, and 4, respectively) of *K. pneumoniae* (WO 01/012833A2). The upper trace in FIG. 1 shows the time course of the GDH reaction with 10 mM glycerol ($K_m$~0.5 mM) as the substrate, while the lower trace shows the effect of including 50 mM 1,3-propanediol ($K_i$~15 mM) in the assay. Clearly, the rate of 3-HP product formation decreases rapidly with time as inactivation occurs, according to a first-order inactivation rate constant ($k_{inact\ obsd}$).

Mutant GDH with Improved Activities

Based on the observed GDH inactivation, a series of mutant GDHs having a reduced inactivation rate, with respect to the wild-type GDH, was created. Typically, the approach involves the creating and isolating mutant enzymes having an increased total turnover number in the presence of glycerol and 1,3-propanediol. This can be achieved by either increasing the $k_{cat}$ and/or decreasing the rate of enzyme inactivation.

The process of improving GDH activity involves construction of an expression vector comprising the GDH gene(s), mutagenesis of the GDH coding sequence, and finally isolation of variants with a decreased inactivation rate. Subsequent rounds of mutagenesis allow for evolution of the GDH coding sequence Mutant $B_{12}$-dependent dehydratase libraries could be prepared using any wild-type (or substantially similar) $B_{12}$-dependent dehydratase as the starting material for mutagenesis.

Traditional Methods of Mutagenesis for $B_{12}$-Dependent Dehydratase

A variety of approaches may be used for the mutagenesis of the $B_{12}$-dependent dehydratase. Two suitable approaches used herein include error-prone PCR (Leung et al., *Techniques*, 1:11-15 (1989); Zhou et al., *Nucleic Acids Res.* 19:6052-6052 (1991); and Spee et al., *Nucleic Acids Res.* 21:777-778 (1993)) and in vivo mutagenesis.

The principal advantage of error-prone PCR is that all mutations introduced by this method will be within the $B_{12}$-dependent dehydratase gene, and any change may be easily controlled by changing the PCR conditions. Alternatively, in vivo mutagenesis may be employed using commercially available materials such as the *E. coli* XL1-Red strain and the Epicurian coli XL1-Red mutator strain from Stratagene (La Jolla, Calif.; see also Greener and Callahan, *Strategies* 7:32-34 (1994)). This strain is deficient in three of the primary DNA repair pathways (mutS, mutD and mutT), resulting in a mutation rate 5000-fold higher than that of wild-type. In vivo mutagenesis does not depend on ligation efficiency (as with error-prone PCR); however, a mutation may occur at any region of the vector and the mutation rates are generally much lower.

Alternatively, it is contemplated that a mutant $B_{12}$-dependent dehydratase with reduced inactivation rate may be constructed using the method of "gene shuffling" (U.S. Pat. No.

5,605,793; U.S. Pat. No. 5,811,238; U.S. Pat. No. 5,830,721; and U.S. Pat. No. 5,837,458) or any similar means of promoting recombinogenic activity between nucleic acids. The method of gene shuffling is particularly attractive due to its facile implementation and high rate of mutagenesis. The process of gene shuffling involves the restriction of a gene of interest into fragments of specific size, in the presence of additional populations of DNA regions of both similarity to (or difference to) the gene of interest. This pool of fragments is then denatured and reannealed to create a mutated gene. The mutated gene is then screened for altered activity.

Wild-type $B_{12}$-dependent dehydratase sequences may be mutated and screened for altered or enhanced activity by this method. The sequences should be double stranded and can be of various lengths ranging from 50 bp to 10 kB. The sequences may be randomly digested into fragments ranging from about 10 bp to 1000 bp, using restriction endonucleases well known in the art (Maniatis, supra). In addition to the full-length sequences, populations of fragments that are hybridizable to all (or portions) of the sequence may be added. Similarly, a population of fragments which are not hybridizable to the wild-type sequence may also be added. Typically these additional fragment populations are added in about a 10-fold to 20-fold excess by weight as compared to the total nucleic acid. Generally this process will allow generation of about 100 to 1000 different specific nucleic acid fragments in the mixture. The mixed population of random nucleic acid fragments are denatured to form single-stranded nucleic acid fragments and then reannealed. Only those single-stranded nucleic acid fragments having regions of homology with other single-stranded nucleic acid fragments will reanneal. The random nucleic acid fragments may be denatured by heating. One skilled in the art could determine the conditions necessary to completely denature the double stranded nucleic acids. Preferably the temperature is from about 80° C. to 100° C. The nucleic acid fragments may be reannealed by cooling. Preferably the temperature is from about 20° C. to 75° C. Renaturation can be accelerated by the addition of polyethylene glycol ("PEG") or salt. The salt concentration is preferably from 0 mM to 200 mM. The annealed nucleic acid fragments are next incubated in the presence of a nucleic acid polymerase and dNTP's (i.e., dATP, dCTP, dGTP and dTTP). The nucleic acid polymerase may be the Klenow fragment, the Taq polymerase or any other DNA polymerase known in the art. The polymerase may be added to the random nucleic acid fragments prior to annealing, simultaneously with annealing or after annealing. The cycle of denaturation, renaturation and incubation in the presence of polymerase is repeated for a desired number of times. Preferably the cycle is repeated from 2 to 50 times, more preferably the sequence is repeated from 10 to 40 times. The resulting nucleic acid is a larger double-stranded polynucleotide of from about 50 bp to about 100 kB and may be screened for expression and altered activity by standard cloning and expression protocols (Maniatis, supra).

In addition to the methods exemplified above (which are designed to directly mutagenize the genes encoding $B_{12}$-dependent dehydratase), traditional methods of creating mutants could be utilized for the purposes described herein. For example, wild-type cells having $B_{12}$-dependent dehydratase activity may be exposed to a variety of agents such as radiation or chemical mutagens and then screened for the desired phenotype. When creating mutations through radiation either ultraviolet (UV) or ionizing radiation may be used. Suitable short wave UV wavelengths for genetic mutations will fall within the range of 200 nm to 300 nm, where 254 nm is preferred. UV radiation in this wavelength principally causes changes within nucleic acid sequence from guanidine and cytosine to adenine and thymidine. Since all cells have DNA repair mechanisms that would repair most UV induced mutations, agents such as caffeine and other inhibitors may be added to interrupt the repair process and maximize the number of effective mutations. Long wave UV mutations using light in the 300 nm to 400 nm range are also possible; but this range is generally not as effective as the short wave UV light, unless used in conjunction with various activators (such as psoralen dyes) that interact with the DNA. Likewise, mutagenesis with chemical agents is also effective for generating mutants and commonly used substances include chemicals that affect nonreplicating DNA (such as $HNO_2$ and $NH_2OH$), as well as agents that affect replicating DNA (such as acridine dyes, notable for causing frameshift mutations). Specific methods for creating mutants using radiation or chemical agents are well documented in the art. See, for example, Thomas D. Brock in Biotechnology: *A Textbook of Industrial Microbiology*, $2^{nd}$ ed.; Sinauer Associates: Sunderland, Mass. (1989); or Deshpande, Mukund V., *Appl. Biochem. Biotechnol.* 36:227 (1992).

Irrespective of the method of mutagenesis, a gene may be evolved such that the enzyme has an increased total turnover number in the presence of glycerol and 1,3-propanediol. This can be achieved by either increasing the $k_{cat}$ and/or decreasing the rate of enzyme inactivation.

Figure 5:
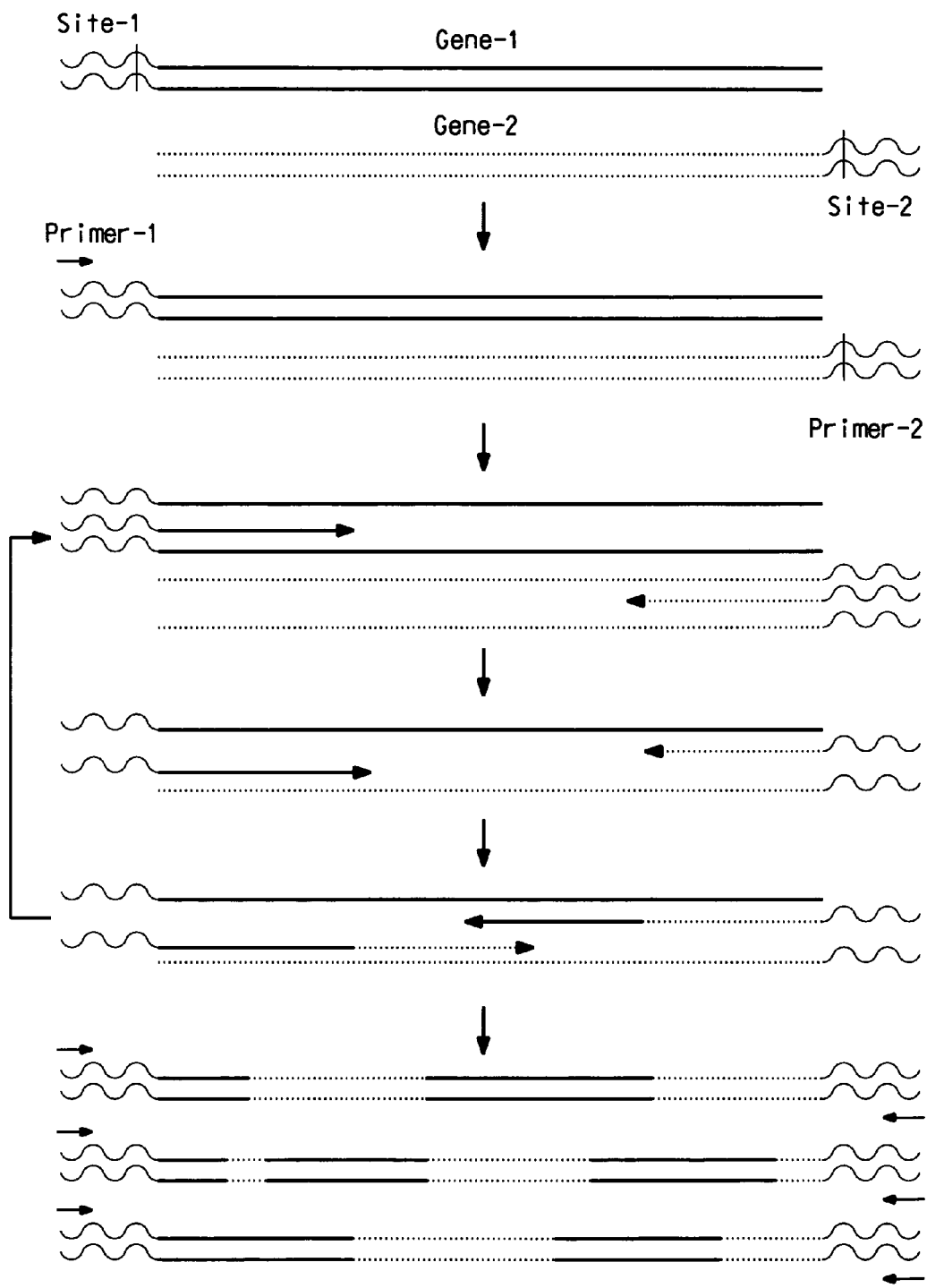
FIG. 5 shows the principle of the recombinogenic extension method using unpaired primers.

Mutagenesis of $B_{12}$-Dependent Dehydratase Using a Recombinogenic Extension Method Using Unpaired Primers FIG. 5 illustrates the principle of the recombinogenic extension method using unpaired primers, based on recombination of two genes. This method requires that the parent genes have different DNA sequences at their 5' and 3' ends. If the parent genes have the same 5' and 3' sequences, a short flanking DNA fragment must be attached to the 5' or 3' end of the genes by standard PCR (as shown in Step A of FIG. 5).

Then, the PCR products can be used as templates for the recombinogenic extension method, following the design of two unpaired primers for the thermal cycling. Primer-1 anneals with the 5' end of template-1, but does not bind with the 5' end of template-2. Primer-2 anneals with the 3' end of template-2, but does not bind to the 3' end of template-1 (Step B). This ensures that neither of the parent templates can be amplified by the thermal cycling reaction.

Short annealing and synthesis cycles are performed, thereby creating a series of short DNA fragments (Step C). With sufficient homology, some of these DNA fragments will anneal to a different template (i.e., "template switching") in a subsequent annealing cycle (Step D). Subsequently, recombinant DNA fragments will be made as shown in FIG. 5. Eventually, recombinant DNA genes with the 5' end of template-1 and the 3' end of template-2 will be created (Step E).

At this time, previously unpaired primer-1 and primer-2 become paired primers for the newly created recombinant genes. Further annealing and synthesis cycles will amplify the pool of recombinant DNA genes with the 5' end of template-1 and 3' end of template-2 (Step F of FIG. 5). During the amplification step, the recombinant DNA genes can be further recombined which will increase the number of crossovers of the recombinant DNA genes. Theoretically, all of the amplified products should be recombinant DNA products. These recombinant products can be derived directly from the parental template molecules, or additional mutations (e.g., insertions, deletions, and substitutions) may be incorporated into the final recombinogenic product. The contamination of the parent templates in the final reaction mixture is negligible.

Further details concerning this methodology are disclosed in U.S. 0/374366, herein incorporated by reference.

Identification of $B_{12}$-Dependent Dehydratase Variants with Improved Kinetic Performance In order to identify (from a large population) those $B_{12}$-dependent dehydratase variants having improved kinetic performance, development of a high throughput assay would greatly facilitate screening. A simple screening method is disclosed herein that relies on two measurements to provide estimations of improvements in $k_{cat}$ and/or total turnover number of a dehydratase variant versus a standard (e.g. wild-type GDH). Specifically, GDH mutant gene libraries were cloned by standard methods into *E. coli* for GDH expression, isolates were obtained and grown in Lennox Broth, permeabilized, and then assayed for GDH activity. While the screening method is described for GDH contained in whole cells, the skilled artisan will recognize that the method can be easily modified to be applicable to enzyme in crude or pure preparations.

The GDH assay developed herein relies on existence of the GDH enzyme in its apoenzyme form in cells that do not have a source of the coenzyme $B_{12}$, dehydratase reactivation factor, or $B_{12}$-independent dehydratase. The catalytically active GDH holoenzyme forms only upon addition of coenzyme $B_{12}$ to the media. Thus, the GDH reaction can effectively be turned "on" with great precision, by addition of coenzyme $B_{12}$ and substrate glycerol. This enables precise control in duration (timing) of a GDH activity and, thus, accuracy in GDH activity measurements. The reaction is initiated at time zero (time=$t_0$) and the product formation during an initial phase of the reaction (immediately after to and before enzyme inactivation occurs, time=$t_1$) is determined. Additionally, the product formation is determined for a longer period of time (immediately after $t_0$ and after enzyme inactivation is complete, time=$t_2$). The determination of product (3-HP) formation is based on a calorimetric aldehyde assay (Zurek G., and U. Karst. *Analytica Chimica Acta*, 351:247-257 (1997)).

For GDH in the presence of saturating coenzyme $B_{12}$ and glycerol concentrations, the amount of 3-HP (y) produced over time is estimated by $$y = T_0 + AMP(1 - \exp(-k_{inact\ obsd} * time)),$$

where $T_0$ is the amount of 3-HP at $t_0$ (background), AMP is amount of 3-HP produced between $t_0$ and when the GDH is totally inactivated (total turnover number), and $k_{inact\ obsd}$ is the observed first order inactivation rate constant. Since 1,3-propanediol is not present, $k_{inact\ obsd}$ is due entirely to $k_{inact}$ glycerol (the first order inactivation rate constant due to glycerol) (see FIG. 1 upper trace. AMP=is equal to $[GDH]*k_{cat}/k_{inact\ obsd}$. The time course is used to establish appropriate times ($t_1$ and $t_2$) for a fixed concentration of GDH, coenzyme $B_{12}$ and glycerol. After correcting for $T_0$, the amount of product formation at $t_1$ (T1, before enzyme inactivation occurs) is used to estimate $[GDH]*k_{cat}$; and, product formation at $t_2$ (T2, after enzyme inactivation is complete) is used to estimate the total turnover number and $[GDH]*k_{cat}/k_{inact\ obsd}$. Thus, the T1 value is directly proportional to $k_{cat}$, the T2 value is directly proportional to $k_{cat}/k_{inact\ obsd}$, and T2/T1 gives $1/k_{inact\ obsd}$.

After appropriate times ($t_1$ and $t_2$) are determined for a fixed concentration of wild-type GDH, coenzyme $B_{12}$ and glycerol (in the absence of 1,3-propanediol), T1 and T2 values are redetermined under the exact assay conditions but with the addition of 1,3-propanediol (FIG. 1, lower trace). In the presence of glycerol and 1,3-propanediol, competitive inhibition occurs; and, $k_{inact\ obsd}$ is a function of both $k_{gly}$ (the first order inactivation rate constant due to glycerol) and $k_{1,3}$-propanediol (the first order inactivation rate constant due to 1,3-propanediol). At appropriate 1,3-propanediol concentration, the T1 value is measureably reduced from the value in the absence of 1,3-propanediol (reflecting the competitive inhibition of 1,3-propanediol and glycerol) and the T2 value is greatly reduced from the value in the absence of 1,3-propanediol (reflecting the fact that $k_{1,3}$-propanediol>$k_{gly}$). For the two-point assay, glycerol is present at a concentration of between 5 and 50 mM, preferably 10 mM; and, 1,3-propanediol is present at a concentration of between 10 and 300 mM, preferably 50 mM.

Applicants have established conditions under which to examine wild-type GDH versus mutant varients in the presence of glycerol and 1,3-propanediol. On a microscopic level, the introduction of mutations to GDH may affect $k_{cat}$, the enzyme's affinity for glycerol and/or 1,3-propanediol, as well as the respective $k_{inact}$ values. Although initially there was no assurance that the affinities and rate constants would vary independently of each other, it was useful to consider how variations in these parameters could affect the results of a two-point (T1 and T2) assay conducted in the presence of 10 mM glycerol and 50 mM 1,3-propanediol. Specifically, slow inactivation (a decrease in the $k_{inact\ obsd}$) results in an increased T2/T1 ratio. On the other hand, variation in either T1 or T2 could result from changes in the intrinsic properties of the enzyme. For example, given constant relative affinities for glycerol and 1,3-propanediol, if $k_{cat}$ and the $k_{inact}$ values were proportionately reduced, T2/T1 would be increased, but T1 would be low. On the other hand, mutants with normal interaction with glycerol but with reduced relative affinity for 1,3-propanediol or a lower rate constant for 1,3-propanediol inactivation should show a roughly normal T1, an elevated T2, and a higher T2/T1 ratio. Mutants with normal glycerol and 1,3-propanediol affinities but with decreased $k_{inact}$ for either compound would also show normal T1 but increased T2 and T2/T1 ratio. An increase in $k_{cat}$ without changes in either $k_{inact}$ or in substrate or 1,3-propanediol affinity would increase T1 and T2, but not the T2/T1 ratio. Despite the numerous variations described above, however, the ultimate goal of the work herein is to increase the total turnover number of the GDH enzyme in the presence of glycerol and 1,3-propanediol. This can be achieved by either increasing the $k_{cat}$ and/or decreasing the rate of enzyme inactivation. Accordingly, mutants that exhibited at least one improvement from the group consisting of higher T1 and/or higher T2 and/or higher T2/T1 values or any combination of those parameters as compared to the wild-type are considered to have improved characteristics.

Measurement of T1 (for the estimation of $k_{cat}$) is not possible when glycerol concentration is small compared to 1,3-propanediol concentration, such that significant inactivation by 1,3-propanediol occurs. These conditions are relevant because high 1,3-propanediol concentration and low glycerol concentration are desirable in a process for the production of 1,3-propanediol. Recognizing this aspect of the problem, a single point assay is provided as described above except that glycerol is present at a concentration of between xx and yy mM, preferably 10 mM; and, 1,3-propanediol is present at a concentration of greater than 300 mM, preferably 600 mM. In this single point assay, the time is indicated by tend and the amount of 3-HP produced is indicated by T(XXX) where XXX is the concentration of 1,3-propanediol (mM).

Identification of Critical Amino Acids Affecting Coenzyme $B_{12}$ Inactivation

Applicants disclose a variety of mutant GDH enzymes that have decreased rates of coenzyme $B_{12}$ inactivation, as compared to the wild-type gene. These mutants were identified using the methods of mutagenesis and screening described above. The mutants, the altered amino acid residues, the $1/k_{inact\ obsd}$ activity (measured as T2/T1), and T2 are summarized in Table 1. The SEQ ID NO: of the DNA sequence of the enzyme is provided in the first column of the Table.

TABLE 3

SUMMARY OF GDH MUTANTS, CHARACTERIZED BY T2/T1

| Strain | Mutations | T2/T1 ratio | T2 |
|---|---|---|---|
| Wild-type GDH (SEQ ID NO:1) | None | 1.00 | 1.00 |
| Xba3007 (SEQ ID NO:40) | ACC(γ-Thr53) to GCC(Ala) | 4.30 | 0.78 |
| Xba3029 (SEQ ID NO:44) | CTC(α-Leu509) to TTC(Phe) | 3.24 | 0.91 |
| Xba3004 (SEQ ID NO:48) | ATG(α-Met306) to CTG(Leu) ACT(β-Thr45) to GCT(Ala) AAC(β-Asn155) to AGC(Ser) | 2.88 | 0.63 |
| Xba3025 (SEQ ID NO:52) | ATC(γ-Ile49) to ACC(Thr) | 2.77 | 0.84 |
| Xba3038 (SEQ ID NO:56) | TTT(α-Phe233) to CTT(Leu) | 2.24 | 0.58 |
| Xba3030 (SEQ ID NO:60) | ATG(α-Met257) to GTG(Val) | 2.00 | 0.59 |
| Xba3006 (SEQ ID NO:64) | GTG(α-Val44) to GCG(Ala) ACC(α-Thr470) to GCC(Ala) | 1.97 | 0.51 |
| Xba3031 (SEQ ID NO:68) | GTC(α-Val226) to GCC(Ala) | 1.92 | 0.64 |
| Xba3017 (SEQ ID NO:72) | ATC(α-Ile105) to ATT(Ile) TCA(α-Ser168) to CCA(Pro) | 1.90 | 0.69 |
| Xba3005 (SEQ ID NO:76) | ATC(α-Ile67) to GTC(Val) GAG(α-Glu209) to GAA(Glu) AAC(β-Asn155) to AAG(Lys) | 1.84 | 0.72 |
| Xba3033 (SEQ ID NO:80) | ATG(α-Met257) to ACG(Thr) GAC(β-Asp181) to GGC(Gly) | 1.75 | 0.72 |
| Xba3032 (SEQ ID NO:84) | TAC(α-Tyr70) to AAC(Asn) GTG(α-Val86) to GAG(Glu) | 1.60 | 0.91 |
| Xba3018 (SEQ ID NO:88) | TAC(α-Tyr70) to AAC(Asn) GTT(α-Val74) to GTC(Val) | 1.60 | 0.79 |
| Xba3014 (SEQ ID NO:92) | CCG(α-Pro430) to TCG(Ser) GAA(β-Glu25) to GAG(Glu) AAA(γ-Lys27) to AGA(Arg) | 1.57 | 0.66 |
| Xba3024 (SEQ ID NO:96) | GTG(α-Val44) to GAG(Glu) GTG(α-Val461) to GGG(Gly) | 1.44 | 0.84 |
| Xba3026 (SEQ ID NO:100) | ACC(α-Thr350) to GCC(Ala) | 1.43 | 0.93 |
| Sma3009 (SEQ ID NO:104) | ATG(α-Met62) to GTG(Val) ATC(α-Ile63) to GTC(Val) AAA(α-Lys149) to AGA(Arg) | 2.75 | 0.71 |
| Sma3010 (SEQ ID NO:108) | ATG(α-Met62) to GTG(Val) GCG(β-Ala53) to GTG(Val) | 2.03 | 0.96 |
| Sma3014 (SEQ ID NO:112) | CAG(α-Gln59) to CGG(Arg) ATT(α-Ile314) to GTT(Val) TTT(β-Phe11) to TTA(Leu) | 1.84 | 0.73 |
| Sma3008 (SEQ ID NO:116) | ATG(α-Met62) to ACG(Thr) CTG(α-Leu268) to CTA(Leu) | 1.75 | 0.95 |
| Sma3001 (SEQ ID NO:120) | AAC(α-Asn520) to AGC(Ser) | 1.56 | 0.97 |
| PpuMI001 (SEQ ID NO:124) | CGG(α-Arg137) to AGG(Arg) TGC(α-Cys143) to TGT(Cys) CTC(α-Leu148) to CGC(Arg) CCG(α-Pro152) to CCC(Pro) | 2.43 | 0.57 |
| PpuMI002 (SEQ ID NO:128) | CGG(α-Arg137) to AGG(Arg) GAT(α-Asp150) to CAT(His) | 2.43 | 0.57 |
| PpuMI005 (SEQ ID NO:132) | CGG(α-Arg137) to AGG(Arg) CAG(α-Gln242) to CAA(Gln) AAA(α-Lys149) to CAA(Gln) CCG(α-Pro152) to CCC(Pro) | 1.85 | 0.81 |
| RsrII001 (SEQ ID NO:136) | TTC(α-Phe339) to GTC(Val) CGC(α-Arg346) to CGG(Arg) | 1.92 | 0.72 |
| Sma3002 (SEQ ID NO:140) | TAT(α-Tyr271) to TGT(Cys) TAC(α-Tyr502) to CAC(His) TAA(stop of α) to CAA(Gln) CAA(β-Gln2) to CGA(Arg) TTT(β-Phe11) to TTC(Phe) | 2.73 | 1.60 |
| Sma3003 (SEQ ID NO:143) | ATG(α-Met62) to CTG(Leu) | 1.95 | 1.16 |
| Xba3015 (SEQ ID NO:147) | GTT(α-Val549) to GCT(Ala) CTG(β-Leu113) to CCG(Pro) GCC(γ-Ala122) to GTC(Val) GCG(γ-Ala128) to GTG(Val) | 2.36 | 1.13 |
| Xba3008 (SEQ ID NO:151) | TCT(β-Ser122) to CCC(Pro) AAA(α-Lys166) to AGA(Arg) | 2.12 | 1.15 |
| Xba3016 (SEQ ID NO:155) | ATC(α-Ile102) to ACC(Thr) | 1.72 | 1.18 |
| Xba3020 (SEQ ID NO:159) | CCG(β-Pro152) to ACG(Thr) | 1.65 | 1.04 |
| Xba3037 (SEQ ID NO:163) | GAG(α-Glu116)to GAA(Glu) GTT(α-Val423) to ATT(Ile) | 1.48 | 1.06 |
| Xba3036 (SEQ ID NO:167) | GGT(α-Gly47) to GGC(Gly) CGA(α-Arg65) to CAA(Gln) | 1.27 | 1.03 |
| 4BR1001 (SEQ ID NO:171) | GGC(α-Gly216) to GGG(Gly) GTG(α-Val224) to CTG(Leu) | 1.90 | 1.10 |
| Xba3010 (SEQ ID NO:175) | CTG(α-Leu318) to TTG(Leu) AAC(α-Asn447) to AAT(Asn) AAT(α-Asn489) to AGT(Ser) GCC(βAla27) to TCC(Ser) | 1.25 | 1.39 |
| Xba3009 (SEQ ID NO:179) | ACG(α-Thr77) to GCG(Ala) TGC(α-Cys193) to AGC(Ser) TAA(stop of a) to GAA(Glu) AAA(β-Lys56) to AGA(Arg) GCC(β-Ala88) to GCT(Ala) GAT(β-Asp111) to GAA(Glu) CAT(γ-His67) to TAT(Tyr) ACC(γ-Thr114) to TCC(Ser) | 0.98 | 1.61 |
| Xba3023 (SEQ ID NO:182) | CAC(α-His96) to CAT(His) ATC(α-Il102) to GTC(Val) GGG(α-Gly63) to GGA(Gly) | 1.00 | 1.22 |
| 2-F4 (SEQ ID NO:186) | GTG(α-Val224) to CTG(Leu) TAT(α-Tyr271) to TGT(Cys) TAC(α-Tyr502) to CAC(His) TAA(stop of α) to CAA(Gln) CAA(β-Gln2) to CGA(Arg) TTT(β-Phe11) to TTC(Phe) | 14.4 | 0.5 |
| 12-B1 (SEQ ID NO:189) | ACG(α-Thr77) to GCG(Ala) TGC(α-Cys193) to AGC(Ser) TAA(stop of a) to GAA(Glu) AAA(β-Lys56) to AGA(Arg) GCC(β-Ala88) to GCT(Ala) GAT(β-Asp111) to GAA(Glu) ACC(γ-Thr53) to GCC(Ala) CAT(γ-His67) to TAT(Tyr) ACC(γ-Thr114) to TCC(Ser) | 4.6 | 1.8 |
| 13-B7 (SEQ ID NO:192) | TAT(α-Tyr271) to TGT(Cys) TAC(α-Tyr502) to CAC(His) TAA(stop of α) to CAA(Gln) CAA(β-Gln2) to CGA(Arg) TTT(β-Phe11) to TTC(Phe) ACC(γ-Thr53) to GCC(Ala) | 2.4 | 0.8 |
| 16-H5 (SEQ ID NO:195) | TAT(α-Tyr271) to TGT(Cys) TAC(α-Tyr502) to CAC(His) CTC(α-Leu509) to TTC(Phe) TAA(stop of α) to CAA(Gln) CAA(β-Gln2) to CGA(Arg) TTT(α-Phe11) to TTC(Phe) | 16.8 | 1.2 |
| 1-E1 (SEQ ID NO:198) | TAA(stop of α) to CAA(Gln) | 0.72 | 1.82 |
| 22-G7 (SEQ ID NO:201) | TAA(stop of α) to GAA(Glu) | 0.75 | 1.79 |
| 7A-C1 (SEQ ID NO:204) | TAT(α-Tyr271) to TGT(Cys) | 1.01 | 0.43 |

TABLE 3-continued

SUMMARY OF GDH MUTANTS, CHARACTERIZED BY T2/T1

| Strain | Mutations | T2/T1 ratio | T2 |
|---|---|---|---|
| 7C-A5 (SEQ ID NO:208) | CAA(β-Gln2) to CGA(Arg) | 1.02 | 0.95 |
| 8-C9 (SEQ ID NO:212) | TAC(α-Tyr502) to CAC(His) TAA(stop of α) to CAA(Gln) CAA(β-Gln2) to CGA(Arg) TTT(β-Phe11) to TTC(Phe) | 1.3 | 1.83 |
| 9-D7 (SEQ ID NO:215) | TAT(α-Tyr271) to TGT(Cys) TAA(stop of α) to CAA(Gln) CAA(β-Gln2) to CGA(Arg) TTT(β-Phe11) to TTC(Phe) | 0.98 | 1.57 |
| 10-G6 (SEQ ID NO:218) | TAT(α-Tyr271) to TGT(Cys) TAC(α-Tyr502) to CAC(His) TAA(stop of α) to CAA(Gln) TTT(β-Phe11) to TTC(Phe) | 2.56 | 1.55 |
| 21-D10 (SEQ ID NO:221) | TAA(stop of α) to CAA(Gln) ACC(γ-Thr53) to GCC(Ala) | 3.85 | 1.91 |
| 20-B9 (SEQ ID NO:225) | CTC(α-Leu509) to TTC(Phe) TAA(stop of α) to CAA(Gln) | 3.86 | 1.95 |
| 18-D7 (SEQ ID NO:229) | TAC(α-Tyr502) to CAC(His) TAA(stop of α) to CAA(Gln) CAA(β-Gln2) to CGA(Arg) TTT(β-Phe11) to TTC(Phe) ACC(γ-Thr53) to GCC(Ala) | 5.38 | 1.30 |
| 17-F6 (SEQ ID NO:233) | TAC(α-Tyr502) to CAC(His) CTC(αLeu509) to TTC(Phe) TAA(stop of α) to CAA(Gln) CAA(β-Gln2) to CGA(Arg) TTT(β-Phe11) to TTC(Phe) | 3.63 | 1.77 |
| 15-E4 (SEQ ID NO:237) | TAC(α-Tyr502) to CAC(His) TAA(stop of α) to CAA(Gln) CAA(β-Gln2) to CGA(Arg) TTT(β-Phe11) to TTC(Phe) GTG(α-Val224) to CTG(Leu) | 3.96 | 1.66 |
| KG002 (SEQ ID NO:241) | CTG(β-Leu113) to CCG(Pro) ACC(γ-Thr114) to GCC(Ala) GCT(α-Ala309) to GCC(Ala) AAC(α-Asn468) to AAT(Asn) | 1.03 | 1.22 |
| KG003 (SEQ ID NO:245) | GTG(α-Val224) to ATG(Met) CCG(α-Pro450) to CCA(Pro) | 1.05 | 0.92 |
| KG004 (SEQ ID NO:249) | GTC(α-Val226) to GCC(Ala) ATG(α-Met306) to TTG(Leu) | 1.53 | 1.14 |
| KG005 (SEQ ID NO:253) | ACT(α-Asn288) to ACC(Asn) ATG(α-Met306) to TTG(Leu) CCG(β-Pro152) to TCG(Ser) | 1.62 | 1.33 |
| KG006 (SEQ ID NO:257) | ATG(α-Met62) to ACG(Thr) | 1.09 | 1.22 |
| KG007 (SEQ ID NO:261) | GTC(α-Val115) to GCC(Ala) CTG(β-Leu13) to CCG(Pro) | 1.11 | 1.16 |
| KG010 (SEQ ID NO:265) | AAT(α-Asn151) to AAC(Asn) TTC(α-Phe513) to CTC(Leu) | 1.15 | 1.06 |
| KG011 (SEQ ID NO:269) | ATG(α-Met214) to TTG(Leu) GCG(α-Ala460) to GCA(Ala) GAA(α-Glu462) to GAG(Glu) ACC(α-Thr499) to GCC(Ala) GAT(β-Asp24 to GGT(Gly) GAA(β-Glu29) to GAG(Glu) CTG(β-Leu58) to CTT(Leu) CGG(β-Arg70) to CGA(Arg) GAG(β-Glu130) to GGG(Gly) AAA(γ-Lys4) to AAG(Lys) | 1.35 | 1.03 |
| KG012 (SEQ ID NO:273) | TTA(α-Leu217) to GTA(Val) | 1.15 | 1.01 |
| KG014 (SEQ ID NO:277) | ATG(α-Met62) to GTGVal) GAT(β-Asp24) to GAA(Glu) | 1.10 | 0.95 |
| KG016 (SEQ ID NO:281) | CGG(α-Arg137) to AGG(Arg) AAC(α-Asn141) to ATC(Ile) GAT(α-Asp150) to GAC(Asp) GCG(α-Ala231) to ACG(Thr) GGC(αGly236) to AGC(Ser) | 0.97 | 1.02 |
| KG017 (SEQ ID NO:285) | TCA(α-Ser41) to TCG(Ser) GCG(α-Ala119) to ACG(Thr) AAC(α-Asn447) to AAT(Asn) | 0.93 | 1.05 |
| KG021 (SEQ ID NO:289) | GTC(α-Val226) to GCC(Ala) | 1.29 | 0.93 |
| KG023 (SEQ ID NO:293) | CCG(α-Pro152) to TCG(Ser) | 1.21 | 0.88 |
| KG001 (SEQ ID NO:297) | AGC(α-Ser219) to AAC(Asn) | 5.7 | 0.80 |

Additional mutants, also identified using the methods of mutagenesis and screening described above, are summarized below in Table 4. This table presents information concerning each mutant, the altered amino acid residues, and the T(600) activity. The SEQ ID NO: of the DNA sequence of the enzyme is provided in the first column of the Table.

TABLE 4

SUMMARY OF GDH MUTANTS, CHARACTERIZED BY T(600)

| Strain | Mutations | $T_{(600)}$ |
|---|---|---|
| Wild-type GDH | — | 1 |
| GDH-SM1-G11 (SEQ ID NO:301) | TAA(stop of α) to CAA(Gln) ACC(γ-Thr53) to TCC(Ser) | 4.3 |
| GDH-SM2-B11 (SEQ ID NO:304) | TAA(stop of α) to CAA(Gln) CTC(α-Leu509) to TTT(Phe) | 4.1 |
| GDH-SM3-D2 (SEQ ID NO:307) | GTG(α-Val224) to TTG(Leu) TAC(α-Tyr502) to CAC(His) TAA(stop of α) to CAA(Gln) CAA(β-Gln2) to CGA(Arg) TTT(β-Phe11) to TTC(Phe) | 4.0 |
| GDH-SM4-H2 (SEQ ID NO:310) | TAA(stop of α) to CAA(Gln) ACC(γ-Thr53) to TGT(Cys) | 4.1 |
| SHGDH12 (SEQ ID NO:319) | GTT(α-Val74) to ATT(Ile) GTG(α-Val224) to TTG(Leu) CGC(α-Arg425) to CGT(Arg) TAC(α-Tyr502) to CAC(His) TAA(stop of α) to CAA(Gln) CAA(β-Gln2) to CGA(Arg) TTT(β-Phe11) to TTC(Phe) AAA(β-Lys14) to AGA(Arg) | 5.9 |
| SHGDH22 (SEQ ID NO:322) | GGC(α-Gly216) to GGG(Gly) GTG(α-Val224) to TTG(Leu) CAG(α-Gln337) to CAA(Gln) CGC(α-Arg533) to GGC(Gly) ACC(α-Thr553) to ACG(Thr) TAA(stop of α) to CAA(Gln) ATC(γ-Ile21) to ACC(Thr) CTG(γ-Leu137) to CTA(Leu) | 5.8 |
| SHGDH24 (SEQ ID NO:328) | CGT(α-Arg134) to CGC(Arg) GGC(α-Gly216) to GGG(Gly) GTG(α-Val224) to TTG(Leu) AGC(α-Ser481) to AGT(Ser) ACC(α-Thr553) to ACG(Thr) TAA(stop of α) to CAA(Gln) | 5.6 |
| SHGDH25 (SEQ ID NO:334) | ATG(α-Met62) to CTG(Leu) GTG(α-Val124) to GCG(Ala) GGC(α-Gly216) to GGG(Gly) GTG(α-Val224) to TTG(Leu) TAA(stop of α) to CAA(Gln) | 5.1 |
| SHGDH29 (SEQ ID NO:337) | GCC(α-Ala376) to GCT(Ala) CTC(α-Leu509) to TTT(Phe) ACC(α-Thr553) to ACG(Thr) TAA(stop of α) to CAA(Gln) CAG(γ-Gln101) to CGG(Arg) | 4.6 |
| SHGDH37 (SEQ ID NO:313) | GTG(α-Val224) to TTG(Leu) TAC(α-Tyr502) to CAC(His) TAA(stop of α) to CAA(Gln) CAA(β-Gln2) to CGA(Arg) | 6.6 |

TABLE 4-continued

SUMMARY OF GDH MUTANTS, CHARACTERIZED BY T(600)

| Strain | Mutations | $T_{(600)}$ |
|---|---|---|
| SHGDH38 (SEQ ID NO:325) | TTT(β-Phe11) to TTC(Phe) GAG(γ-Glu35) to AAG(Lys) GTG(α-Val224) to TTG(Leu) TAC(α-Tyr502) to CAC(His) TAA(stop of α) to CAA(Gln) CAA(β-Gln2) to CGA(Arg) TTT(β-Phe11) to TTC(Phe) | 5.7 |
| SHGDH43 (SEQ ID NO:331) | GGG(β-Gly19) to GAG(Glu) GAA(β-Glu64) to GAG(Glu) CTT(β-Leu67) to CTC(Leu) AAT(γ-Asn72) to AGT(Ser) GGC(α-Gly216) to GGG(Gly) GTG(α-Val224) to TTG(Leu) GAG(α-Glu240) to GAA(Glu) GTG(α-Val301) to GTA(Val) ACC(α-Thr553) to ACG(Thr) TAA(stop of α) to CAA(Gln) AAA(β-Lys166) to AGA(Arg) AAA(β-Lys173) to GAA(Glu) ACC(γ-Thr53) to TCC(Ser) | 5.6 |
| SHGDH51 (SEQ ID NO:316) | TTC(α-Phe339) to GTC(Val) CGC(α-Arg346) to CGG(Arg) ACC(α-Thr553) to ACG(Thr) TAA(stop of α) to CAA(Gln) CCC(β-Pro184) to CCT(Pro) ACC(γ-Thr53) to GCC(Ala) | 6.2 |

A variety of mutant GDH enzymes are disclosed above having decreased rates of coenzyme $B_{12}$ inactivation. Preferred mutants of the present invention include: SEQ ID NOS: 40, 44, 48, 52, 56, 60, 64, 68, 72, 76, 80, 84, 88, 92, 96, 100, 104, 108, 112, 116, 120, 124, 128, 132, 136, 140, 143, 147, 151, 155, 159, 163,167, 171, 175, 179, 182, 186, 189, 192, 195, 198, 201, 204, 208, 212, 215, 218, 221, 225, 229, 233, 237, 241, 245, 249, 253, 257, 261, 265, 269, 273, 277, 281, 285, 289, 293, 297, 301, 304, 307, 310, 313, 316, 319, 322, 325, 328, 331, 334, and 337. More preferred mutants of the present invention are SEQ ID NOs: 140, 179, 186, 189, 192, 195, 198, 201, 212, 215, 218, 301, 304, 307, 310, 313, 316, 319, 322, 325, 328, 331, 334, and 337. Most preferred mutants of the present invention are SEQ ID NOs: 313, 322, and 328.

In addition to the mutants above, a large pool of mutants having improved reaction kinetics could also be synthesized, each further having some combination of the mutations listed in Tables 2 and 3. For example, each mutation in a mutant GDH having multiple-point mutations can be evaluated for desirable effects toward improving the overall reaction kinetics of the enzyme. Any mutations that did not enhance the reaction kinetics could be returned to the wild-type sequence, if desired. Likewise, a GDH mutant from the list above having only a single-point mutation could be combined with another mutation disclosed above, to further improve the enzyme's activity. Applicants disclose the following useful mutations in a GDH enzyme, which may be used in a variety of combinations to produce alternative mutant GDH enzymes that have decreased rates of coenzyme $B_{12}$ inactivation, as compared to the wild-type gene. These mutations include:

1. In the α-subunit: TCA(α-Ser41) to TCG(Ser); GTG(α-Val44) to GCG(Ala); GTG(α-Val44) to GAG(Glu); GGT(α-Gly47) to GGC(Gly); CAG(α-Gln59) to CGG(Arg); ATG(α-Met62) to ACG(Thr); ATG(α-Met62) to GTG(Val); ATG(α-Met62) to CTG(Leu); ATC(α-Ile63) to GTC(Val); GGG(α-Gly63) to GGA(Gly); CGA(α-Arg65) to CAA(Gln); ATC(α-Ile67) to GTC(Val); TAC(α-Tyr70) to AAC(Asn); GTT(α-Val74) to GTC(Val); GTT(α-Val74) to ATT(Ile); ACG(α-Thr77) to GCG(Ala); GTG(α-Val86) to GAG(Glu); CAC(α-His 96) to CAT(His); ATC(α-Ile102) to ACC(Thr); ATC(α-Ile102) to GTC(Val); ATC(α-Ile105) to ATT(Ile); GTC(α-Val115) to GCC(Ala); GAG(α-Glu116) to GM(Glu); GCG(α-Ala119) to ACG(Thr); GTG(α-Val124) to GCG(Ala); CGT(α-Arg134) to CGC(Arg); CGG(α-Arg137) to AGG(Arg); MC(α-Asn141) to ATC(Ile); TGC(α-Cys143) to TGT(Cys); CTC(α-Leu148) to CGC(Arg); AAA(α-Lys149) to AGA(Arg); AAA(α-Lys149) to CAA(Gln); GAT(α-Asp150) to CAT(His); GAT(α-Asp150) to GAC(Asp); MT(α-Asn151) to MC(Asn); CCG(α-Pro152) to CCC(Pro); TCA(α-Ser168) to CCA(Pro); TGC(α-Cys193) to AGC(Ser); GAG(α-Glu209) to GM(Glu); ATG(α-Met214) to TTG(Leu); GGC(α-Gly216) to GGG(Gly); TTA(α-Leu217) to GTA(Val); AGC(α-Ser219) to MC(Asn); GTG(α-Val224) to CTG(Leu); GTG(α-Val224) to ATG(Met); GTG(α-Val224) to TTG(Leu); GTC(α-Val226) to GCC(Ala); GCG(α-Ala231) to ACG(Thr); TTT(α-Phe233) to CTT(Leu); GGC (aGly236) to AGC(Ser); GAG(α-Glu240) to GM(Glu); CAG(α-Gln242) to CM(Gln); ATG(α-Met257) to GTG(Val); ATG(α-Met257) to ACG(Thr); CTG(α-Leu268) to CTA(Leu); TAT(α-Tyr271) to TGT(Cys); ACT(α-Asn288) to ACC(Asn); GTG(α-Val301) to GTA(Val); ATG(α-Met306) to CTG(Leu); ATG(α-Met306) to TTG(Leu); GCT(α-Ala309) to GCC(Ala); ATT(α-Ile314) to GTT(Val); CTG(α-Leu318) to TTG(Leu); CAG(α-Gln337) to CM(Gln); TTC(α-Phe339) to GTC(Val); CGC(α-Arg346) to CGG(Arg); ACC(α-Thr350) to GCC(Ala); GCC(α-Ala376) to GCT(Ala); GTT (α-Val423) to ATT(Ile); CGC(α-Arg425) to CGT(Arg); CCG(α-Pro430) to TCG(Ser); MC(α-Asn447) to MT(Asn); CCG(α-Pro450) to CCA(Pro); GCG(α-Ala460) to GCA(Ala); GTG(α-Val461) to GGG(Gly); GAA(α-Glu462) to GAG(Glu); AAC(α-Asn468) to MT(Asn); ACC(α-Thr470) to GCC(Ala); AGC(α-Ser481) to AGT(Ser); MT(α-Asn489) to AGT(Ser); ACC(α-Thr499) to GCC(Ala); TAC(α-Tyr502) to CAC(His); CTC(α-Leu509) to TTC(Phe); CTC(α-Leu509) to TTT(Phe); TTC(α-Phe513) to CTC(Leu); MC(α-Asn520) to AGC(Ser); CGC(α-Arg533) to GGC(Gly); GTT (α-Val549) to GCT(Ala); ACC(α-Thr553) to ACG(Thr); TM(stop of a) to CAA(Gln); TAA(stop of α) to GM(Glu);

2. In the β-subunit: CAA(β-Gln2) to CGA(Arg);TTT(β-Phe11) to TTA(Leu); TTT(β-Phe11) to TTC(Phe); CTG(β-Leu13) to CCG(Pro); AAA(β-Lys14) to AGA(Arg); GGG(β-Gly19) to GAG(Glu); GAT(β-Asp24 to GGT(Gly); GAT(β-Asp24) to GM(Glu); GAA(β-Glu25) to GAG(Glu); GCC(β-Ala27) to TCC(Ser); GAA(β-Glu29) to GAG(Glu); ACT(β-Thr45) to GCT(Ala); GCG(β-Ala53) to GTG(Val); AAA(β-Lys56) to AGA(Arg); CTG(β-Leu58) to CTT(Leu); GM(β-Glu64) to GAG(Glu); CTT(β-Leu67) to CTC(Leu); CGG(β-Arg70) to CGA(Arg); GCC(β-Ala88) to GCT(Ala); GAT(β-Asp111) to GAA(Glu); CTG(β-Leu113) to CCG(Pro); TCT(β-Ser122) to CCC(Pro); GAG(β-Glu130) to GGG(Gly); CCG(β-Pro152) to ACG(Thr); CCG(β-Pro152) to TCG(Ser); AAC(β-Asn155) to AGC(Ser); MC(β-Asn155) to MG(Lys); AAA(β-Lys166) to AGA(Arg); AAA(β-Lys173) to GM(Glu); GAC(β-Asp181) to GGC(Gly); CCC(β-Pro184) to CCT(Pro); and 3. In the γ-subunit: AAA(γ-Lys4) to AAG(Lys); ATC(γ-Ile21) to ACC(Thr); AAA(γ-Lys27) to AGA(Arg); GAG(γ-Glu35) to MG(Lys); ATC(γ-1e49) to ACC(Thr); ACC(γ-Thr53) to GCC(Ala); ACC(γ-Thr53) to TCC(Ser); ACC(γ-Thr53) to TGT(Cys); CAT(γ-His67) to TAT(Tyr); AAT(γ-Asn72) to AGT(Ser); CAG(γ-Gln101) to CGG(Arg); ACC(γ-Thr114) to TCC(Ser); ACC(γ-Thrl 14) to GCC(Ala); GCC(γ-Ala122) to GTC(Val); GCG(γ-Ala128) to GTG(Val); and CTG(γ-Leu137) to CTA(Leu).

Similar nucleotide and amino acid mutations could be made in other $B_{12}$-dependent dehydratases other than wild-type GDH. Aligning the $B_{12}$-dependent dehydratase of interest with GDH would indicate the exact nucleotide/base position that required mutation.

The invention encompasses not only the specific mutations described above, but also those that allow for the substitution of chemically equivalent amino acids. So, for example, where a substitution of an amino acid with the aliphatic, nonpolar amino acid alanine is made, it will be expected that the same site may be substituted with the chemically equivalent amino acid serine.

Protein Engineering of Dehydratases

It is now possible to attempt to modify many properties of proteins by combining information on three-dimensional structure and classical protein chemistry with methods of genetic engineering and molecular graphics, i.e. protein engineering. This approach to obtaining enzymes with altered activities relies first on the generation of a model molecule, or the use of a known structure that has a similar sequence to an unknown structure.

For the purposes herein, the 3-dimensional crystal structure of substrate-free form $B_{12}$-dependent glycerol dehydratase has been previously determined by X-ray crystallography (Liao et al., *J. Inorganic Biochem.* (in press)); additionally, the structure of the enzyme in complex with 1,2-propanediol has also been reported (Yamanishi et al., *Eur. J. Biochem.* 269:4484-4494 (2002)). With these 3-dimensional models of $B_{12}$-dependent glycerol dehydratases, and an understanding of where "hot spots" of mutations are typically located within those dehydratase enzymes showing improved activity in reaction kinetics (such that the rate of suicide inactivation is reduced), one can target regions within the dehydratase structure where alternative modifications in structure might bring about desired changes in the properties of the protein. Thus, for example, regional site-directed mutagenesis targeted toward the following wild type residues would be expected to yield additional dehydratase mutants with improved catalytic activities:

1.) Residues 62-70 (encompassing the second α helix from the N-terminal of the α-subunit); and/or
2.) Residues 219-236 (a region in the vicinity of the active site, encompassing a portion of the fourth β-strand of the TIM barrel and the following loop and a short helix of the α-subunit).

Expression of a Recombinant Dehydratase in a Host Cell

Suitable host cells for the recombinant production of 3-HP and 1,3-propanediol by the expression of a gene encoding a dehydratase may be either prokaryotic or eukaryotic and will be limited only by their ability to express active enzymes. Preferred hosts will be those typically useful for production of 3-HP or 1,3-propanediol such as *Citrobacter, Enterobacter, Clostridium, Klebsiella, Aerobacter, Lactobacillus, Aspergillus, Saccharomyces, Schizosaccharomyces, Zygosaccharomyces, Pichia, Kluyveromyces, Candida, Hansenula, Debaryomyces, Mucor, Torulopsis, Methylobacter, Escherichia, Salmonella, Bacillus, Streptomyces* and *Pseudomonas*. More preferred in the present invention are *Escherichia coli, E. blattae, Klebsiella, Citrobacter*, and *Aerobacter*.

Vectors, methods of transformation, and expression cassettes suitable for the cloning, transformation and expression of genes encoding a suitable dehydratase into a host cell will be well known to one skilled in the art. Suitable vectors are those which are compatible with the bacterium used as a host cell. Thus, suitable vectors can be derived, for example, from a bacteria, a virus (e.g., bacteriophage T7 or a M-13 derived phage), a cosmid, a yeast, or a plant. Protocols for obtaining and using such vectors are known to those individuals in the art (Sambrook et al., supra).

Typically, the vector or cassette contains sequences directing transcription and translation of the relevant gene(s), a selectable marker, and sequences allowing autonomous replication or chromosomal integration. Suitable vectors comprise a region 5' of the gene that harbors transcriptional initiation controls and a region 3' of the DNA fragment that controls transcriptional termination. It is most preferred when both control regions are derived from genes homologous to the transformed host cell although it is to be understood that such control regions need not be derived from the genes native to the specific species chosen as a production host.

Initiation control regions (or promoters) useful to drive expression of the relevant genes of the present invention in the desired host cell are numerous and familiar to those skilled in the art. Virtually any promoter capable of driving these genes is suitable for the present invention including, but not limited to: CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, trp, λPL, $λP_R$, T7, tac, and trc (useful for expression in *E. coli*).

Termination control regions may also be derived from various genes native to the preferred hosts. Optionally, a termination site may be unnecessary; however, it is most preferred if included.

Once suitable cassettes are constructed they are used to transform appropriate host cells. Introduction of the cassette containing the genes encoding a mutant dehydratase into a host cell may be accomplished by known procedures such as by transformation (e.g., using calcium-permeabilized cells, electroporation), or by transfection using a recombinant phage virus (Sambrook et al., supra).

Industrial Production via Fermentation

Fermentation media in the present invention must contain suitable carbon substrates. Suitable substrates are well known to one of skill in the art of fermentation science. Preferred carbon substrates are glycerol, dihydroxyacetone, monosaccharides, oligosaccharides, polysaccharides, and one-carbon substrates. More preferred are sugars (e.g., glucose, fructose, sucrose) and single carbon substrates (e.g., methanol and carbon dioxide). Most preferred is glucose.

In addition to an appropriate carbon source, fermentation media must contain suitable minerals, salts, cofactors, buffers and other components, known to those skilled in the art, suitable for the growth of the cultures and promotion of the enzymatic pathway necessary for 3-HP and 1,3-propanediol production. Particular attention is given to Co(II) salts and/or vitamin $B_{12}$ or precursors thereof.

Typically, cells are grown at 30° C. in appropriate media. Preferred growth media in the present invention are common commercially prepared media such as Luria Bertani (LB) broth, Sabouraud Dextrose (SD) broth or Yeast Malt Extract (YM) broth. Other defined or synthetic growth media may also be used and the appropriate medium for growth of the particular microorganism will be known by someone skilled in the art of microbiology or fermentation science.

It is contemplated that the present invention may be practiced using batch, fed-batch or continuous processes and that any known mode of fermentation would be suitable (a variety of methods are detailed by Brock, supra). Additionally, it is contemplated that cells may be immobilized on a substrate as whole cell catalysts and subjected to fermentation conditions for 3-HP or 1,3-propanediol production.

It is expected that improved $B_{12}$-dependent dehydratase mutants will be useful for the production of 3-HP and 1,3-propanediol in a variety of processes, independent of the carbon substrate used (U.S. Pat. No. 5,686,276, glycerol to 3-HPA). Recombinants of the relevant strains could be swapped out of the dehydratase described in the plasmids of U.S. Ser. No. 10/420,587 (DuPont 2002), which is incorporated herein by reference.

The present invention is further defined in the following EXAMPLES. It should be understood that these EXAMPLES, while indicating preferred embodiments of the invention, are given by way of illustration only. From the above discussion and these EXAMPLES, one skilled in the art can ascertain the essential characteristics of this invention, and without departing from the spirit and scope thereof, can make various changes and modifications of the invention to adapt it to various usages and conditions.

EXAMPLES

General Methods

Procedures required for PCR amplification, DNA modifications by endo- and exonucleases (for generating desired ends for cloning of DNA and ligation), and bacterial transformation are well known in the art. Standard molecular cloning techniques are used herein and are described by Sambrook, J., Fritsch, E. F. and Maniatis, T. in *Molecular Cloning: A Laboratory Manual*, $2^{nd}$ ed. (Cold Spring Harbor Laboratory: Cold Spring Harbor, N.Y., 1989; hereinafter "Maniatis"); by Silhavy, T. J., Bennan, M. L. and Enquist, L. W. in *Experiments with Gene Fusions* (Cold Spring Harbor Laboratory: Cold Spring, N.Y., 1984); and by Ausubel et al. in *Current Protocols in Molecular Biology* (Greene Publishing and Wiley-Interscience; 1987).

Materials and methods suitable for the maintenance and growth of bacterial cultures are well known in the art. Techniques suitable for use in the following examples may be found as set out in: 1.) *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, Eds., American Society for Microbiology: Washington, D.C., 1994); or 2.) by Brock, T. D. in *Biotechnology: A Textbook of Industrial Microbiology*, 2nd ed. (Sinauer Associates: Sunderland, Mass., 1989). All reagents, restriction enzymes and materials used for the growth and maintenance of bacterial cells were obtained from Aldrich Chemicals (Milwaukee, Wis.), DIFCO Laboratories (Detroit, Mich.), GIBCO/BRL (Gaithersburg, Md.), Sigma Chemical Company (St. Louis, Mo.), or Promega (Madison, Wis.), unless otherwise specified. PCR reactions were run on Gene-AMP PCR System 9700 using Amplitaq or Amplitaq Gold enzymes (PE Applied Biosystems, Foster City, Calif.), unless otherwise specified. The cycling conditions and reactions were standardized according to the manufacturers' instructions, unless otherwise specified herein.

DNA sequencing reactions were performed on an ABI 377 automated sequencer (PE Applied Biosystems) or on a PTC-200 DNA Engine (MJ Research, Waltham, Mass.) using the Expand High Fidelity PCR System (Roche Applied Science, Indianapolis, Ind.), unless otherwise specified. Likewise, data was managed using the Vector NTI program (InforMax, Inc., Bethesda, Md.) or DNAstar program (DNASTAR Inc., Madison, Wis.).

The meaning of abbreviations is as follows: The meaning of abbreviations is as follows: "sec" means second(s), "min" means minute(s), "hr" means hour(s), "d" means day(s), "µL" means microliter(s), "mL" means milliliter(s), "L" means liter(s), "mm" means millimeter(s), "µm" means micrometer(s), "nm" means nanometer(s), "mM" means millimolar, "µM" means micromolar, "nM" means nanomolar, "M" means molar, "mmol" means millimole(s), "µmol" mean micromole(s), "ng" means nanogram, "mg" means milligram(s), "g" means gram(s), "kB" means kilobase(s), "mU" means milliunit(s), and "U" means unit(s).

Strains, Vectors and Culture Conditions

*Escherichia coli* BL21 (DE3) cells were used for enzyme over-expression (Shuster, B. and Retey, J., *FEBS Lett.* 349: 252-254 (1994)). *Escherichia coli* XL1-Blue cells were purchased from Stratagene (La Jolla, Calif.). Wild-type *Escherichia coli* 5K was originally obtained from *Coli* Genetic Stock Center (CGSC #4510; Yale University, New Haven, Conn.) and lysogenized with lambda DE3 (5K(DE3)). Vector pBluescript II SK+ was purchased from Stratagene.

All kits for molecular biological applications were used according to the manufacturers' instructions, unless otherwise specified.

Example 1

Construction of the "Xba-Library"

Random Mutagenesis Targeting the α-, β- and γ-Subunits of GDH

A random mutant library targeting the *Klebsiella pneumonia* dhaB1, dhaB2, and dhaB3 genes was created, using error-prone PCR amplification. Representative sequence analysis of the library demonstrated that there were approximately 4.2 point mutations per kB; enzyme activity measurements determined that about 15-25% of the mutants in the library were active.

Error-Prone PCR Amplification

Emptage et al. (WO01/12833) describes the construction of plasmid pDT2, which comprises the *Klebsiella pneumonia* dhaB1, dhaB2, and dhaB3 genes (SEQ ID NO:1). The plasmid pGD20 was constructed by inserting the HindIII/XbaI fragment of pDT2 (containing dhaB1, dhaB2, and dhaB3) into pBluescript II SK+ (Stratagene), which places expression of the GDH genes under the control of the T7 promoter.

A randomly generated mutant library targeting all three genes of GDH was created. First, the sequence comprising dhaB1 (1668 bp), dhaB2 (585 bp) and dhaB3 (426 bp) was amplified from pGD20 by error-prone PCR using the following primers: DHA-F1 (SEQ ID NO:5) and DHA-R1 (SEQ ID NO:6). A Clontech mutagenesis kit (Clontech Laboratories, Inc., Palo Alto, Calif.) was used for performing error-prone PCR. The reaction mixture consisted of the following: 38 µl PCR grade water, 5 µl 10×AdvanTaq Plus Buffer, 2 µl MnSO₄ (8 mM), 1 µl dGTP (2 mM), 1 µl 50× Diversify dNTP Mix, 1 µl Primer mix, 1 µl template DNA, and 1 µl AdvanTaq Plus Polymerase. The thermal cycling reaction was carried out according to the manufacturers' instructions. The 2.7 kB PCR products were digested with Hind III/Xba I, and prepared for ligation.

Mutant Library Construction

Although the entire insert containing all three genes of GDH can be removed from the pGD20 construct using a Hind III and Xba I digestion, the insert size is approximately 2.7 kB, while the vector size is about 2.9 kB. To facilitate separation of these two fragments on an agarose gel, pGD20 was digested using Hind III, Xba I and Pst I. Pst I does not cut the vector, instead only cutting the insert in three places to yield four small fragments from the insert. Thus, the digested vector migrated around 2.9 kB on the agarose gel without contamination from other DNA fragments. The Hind III/Xba I/Pst I-digested vector was then ligated with Hind III/Xba I-digested error-prone PCR products. After ethanol precipitation, the ligation mixture was ready for transformation.

Transformation of Ligation Mixtures

Since the T7 promoter was used for the mutant library, an *E. coli* cell lysogenized with lambda DE3 was utilized as the host cell for mutant enzyme expression. Specifically, a 5K(DE3) *E. coli* strain was used for mutant library construction. First, electroporation-competent 5K(DE3) cells were made as follows: 2.5 mL of overnight cell culture was added to 500 mL of LB broth in a 2 L sterile flask. The culture was incubated at 37° C. on a shaker until the $OD_{600}$ reached 0.5 to 0.8. The cells were then incubated on ice for 10 min, followed by centrifugation at 4° C. for 10 min. After washing the cells once with 500 mL ice-cold water, the cells were resuspended in 1-2 mL of 10% ice-cold glycerol. Aliquots (50 μL) were made in sterile eppendorf tubes, and immediately frozen in dry ice. The competent cells were stored at −80° C.

For transformation, 1 μL of ligation mixture was added to 40 μL of competent cells, and the sample was transferred into an electroporation cuvette with a 0.1 cm gap. A voltage of 1.7 kv/cm was used for electroporation. The cells were plated onto LB plates in the presence of ampicillin and incubated overnight at 37° C.

DNA Sequence Analysis of the "Xba" Mutant Library

Nine (9) mutant colonies were randomly picked for DNA sequencing analysis. After sequencing, the number of mutations produced, the location of mutations, and the particular types of mutations observed were analyzed for each mutant. The analysis revealed that all types of base substitutions were present in the mutants, indicating lack of bias for a particular mutation type. In addition, only one deletion mutation was observed in the 9 mutant clones analyzed; no base insertion mutations were identified. This indicated that the frequency of deletion and insertion in the mutant libraries was very low. The average mutation rate was 4.2 point mutations per kB. GDH activity measurements showed that about 15-25% of the mutants in the library were active.

Example 2

Construction of the "Sma-Library"

Random Mutagenesis Targeting the α-Subunit and a Portion of the β-Subunit of GDH A second random mutant library targeting primarily the *Klebsiella pneumonia* dhaB1 gene was generated. Representative sequence analysis of the library demonstrated that there were approximately 4.5 point mutations per kB; enzyme activity measurements determined that about 15-25% of the mutants in the library were active.

Error-Prone PCR Amplification and Mutant Library Construction

The following primers were used to amplify, by error-prone PCR using pGD20 as template, the entire dhaB1 gene and an approximately 200 bp portion of the dhaB2 gene: DHA-F1 (SEQ ID NO:5) and DHA-R2 (SEQ ID NO: 7). Error-prone PCR reactions were performed using a Clontech mutagenesis kit, as described in EXAMPLE 1. The 1.9 kB PCR products were then digested with Hind III and Sma I.

To prepare the vector, the pGD20 plasmid was digested with Hind III and Sma I (to remove the wild-type dhaB1 gene and a portion of the dhaB2 gene) and then purified from an agarose gel. The Hind III/Sma I-digested error-prone PCR product was ligated with the Hind III/Sma I-digested pGD20 vector. The ligation mixtures were transformed into *E. coli* 5K(DE3) by electroporation, in a manner similar to that described for creation of the mutant library in EXAMPLE 1.

DNA Sequence Analysis of the "Sma" Mutant Library

Ten (10) mutant colonies were randomly picked for DNA sequencing analysis, to examine the integrity of the library. For each mutant, the number of mutations produced, the location of mutations, and the particular types of mutations observed were determined. Based on these results, the average mutation rate in the Sma-library was determined to be 4.5 point mutations per kB. There was no apparent bias for any particular mutation type, and the frequency of deletion and insertion in the mutant library was very low. Enzyme activity measurements revealed that approximately 15-25% of the mutants in the library were active.

Example 3

Regional Random Mutagenesis Targeting Amino Acids No. 141-152 (the "PpuMI-library"), 219-226 (the "4BR1-library") and 330-342 (the "RsrII-library") of the α-Subunit of GDH Based on the crystal structure of GDH (Liao et al., *J. Inorganic Biochem.* 93(1-2): 84-91 (2003); Yamanishi et al., *Eur. J. Biochem.* 269: 4484-4494 (2002)), the following regions of the α-subunit of GDH were targeted for regional random mutagenesis: 1) amino acids No. 141-152; 2) amino acids No. 219-226; and 3) amino acids No. 330-342. Since each of these regions was fairly short in length, an oligo-directed mutagenesis approach was used to make these three mutant libraries. This involved a multi-step process wherein a silent mutation corresponding to a unique restriction site upstream or downstream of each region to be mutated was first created to facilitate cloning. Then, degenerate oligonucleotide primers were prepared and used in PCR reactions to mutagenize the targeted regions of the α-subunit. These mutagenized PCR fragments were then cloned into *E. coli* to create the "PpuMI-library", "4BR1-library", and "RsrII-library".

Introducing Silent Mutations in pGD20

One silent mutation was produced upstream or downstream of each targeted region, for the creation of a unique restriction site in plasmid pGD20. The following pairs of primers were used for making point mutations for each region. The nucleotide shown in capitalized, boldface lettering in each primer shows the location of the specific mutation to be introduced.

TABLE 5

Formation of Silent Mutations within Targeted Amino Acids

| Amino Acid Region | RE Site and Location | Forward Primer | Reverse Primer |
| --- | --- | --- | --- |
| a.a.141-a.a.152 | PpuMI; 14 bp upstream of amino acid target region | pGD20RM-F1: 5'-gaa gat gcg tgc ccg cAg gac ccc ctc caa cca-3' (SEQ ID NO:8) | PGD20RM-R1: 5'-tgg ttg gag ggg gtc cTg cgg gca cgc atc ttc-3' (SEQ ID NO: 9) |

TABLE 5-continued

Formation of Silent Mutations within Targeted Amino Acids

| Amino Acid Region | RE Site and Location | Forward Primer | Reverse Primer |
|---|---|---|---|
| a.a.219-a.a.226 | HpaI; 4 bp upstream of amino acid target region | TB4BF:<br>5'-gag ctg ggc atg cgt ggG tta acc agc tac gcc gag-3'<br>(SEQ ID NO: 10) | TB4BR:<br>5'-ctc ggc gta gct ggt taa Ccc acg cat gcc cag ctc-3'<br>(SEQ ID NO:11) |
| a.a.330-a.a.342 | Rsr II; 11 bp downstream of amino acid target region | pGD20RM-F2:<br>5'-act cgg ata ttc gcc gGa ccg cgc gca ccc tga-3'<br>(SEQ ID NO:12) | pGD20RM-R2:<br>5'-tca ggg tgc gcg cgg tCc ggc gaa tat ccg agt-3'<br>(SEQ ID NO:13) |

The mutagenesis experiments were carried out using Stratagene's QuikChange site-directed mutagenesis kits (La Jolla, Calif.), according the manufacturers' instructions. Following mutagenesis, plasmid was purified from each mutant clone. The point mutations were confirmed by restriction enzyme digestion, followed by direct DNA sequence analysis.

Oligo-Directed Mutagenesis

To make the regional random mutant libraries, three degenerate oligonucleotides were synthesized (pGD20 RM-F3, TB4B-R1, and pGD20 RM-R4, as shown below). Normal conditions were used for oligonucleotide synthesis for those nucleotides shown in capital letters. In contrast, nucleotides shown in lowercase, boldface text utilized the degenerate nucleotide mixtures shown beneath each primer during synthesis. Thus, 1-2 point mutations were predicted to result in each "degenerate region" of the primer.

pGD20 RM-F3 (for a.a.141-a.a.152 region—"PpuMI library"):

5'-GCC CGC AGG ACC CCC TCC aac cag tgc cac gtc acc aat ctc aaa gat aat ccg GTG CAG ATT-3' (SEQ ID NO: 15)
  a=94% A mixed with 2% G, 2% C and 2% T;
  g=94% G mixed with 2% A, 2% C and 2% T;
  c=94% C mixed with 2% G, 2% A and 2% T;
  t=94% T mixed with 2% G, 2% C and 2% A.

TB4B-R1 (for a.a.219-a.a.226 region—"4BR1 library"):

5'-GCG TGG GTT MC cag cta cgc cga gac ggt gtc ggt cta cGG CAC CGA AGC GGT ATT TAC C-3' (SEQ ID NO: 16)
  a=94% A mixed with 2% G, 2% C and 2% T;
  g=94% G mixed with 2% A, 2% C and 2% T;
  c=94% C mixed with 2% A, 2% T and 2% G;
  t=94% T mixed with 2% A, 2% G and 2% C.

pGD20 RM-R4.(for a.a.330-a.a.342 region—"RsrII library"):

5'-GGT GCG CGC GGT GCG GCG AAT ATC cga gtg gga gaa agt ctg gtc gtt ggc gga cgc cac ttc GAG GTC GAG-3' (SEQ ID NO: 17)
  a=95% A mixed with 1.66% G, 1.66% C and 1.66% T;
  g=95% G mixed with 1.66% A, 1.66% C and 1.66% T;
  c=95% C mixed with 1.66% G, 1.66% A and 1.66% T;
  t=95% T mixed with 1.66% G, 1.66% C and 1.66% A.

High fidelity PCR reactions were then performed to produce mutagenic PCR fragments using the following primer pairs:
  PpuMI-library: pGD20 RM-F3 and DHA-R2 (SEQ ID NOs: 15 and 7);
  4BR-1 library: TB4B-R1 and GD-C (SEQ ID NOs: 16 and 14);
  RsrII-library: DHA-F1 and pGD20 RM-R4 (SEQ ID NOs: 5 and 17).

The PCR fragments were purified from an agarose gel and then digested with PpuM I/Xba I (for the PpuMI-library), HpaI/XbaI (for the 4BR-1 library), and Hind III/Rsr II (for the RsrII-library), respectively.

Mutant Library Construction

The mutated pGD20 construct (in which PpuM I, HpaI or Rsr II unique restriction enzyme digestion sites had been introduced by site-directed mutagenesis), was digested with PpuM I/Xba 1, HpaI/XbaI or Hind III/Rsr II, respectively. The linearized vectors were purified from agarose gels, and then ligated with the restriction enzyme-digested PCR products. Mutant libraries were prepared by electroporating the ligation mixtures into E. coli strain 5K(DE3), as described in EXAMPLE 1.

Sequencing Analysis for Regional Libraries

Between 9 and 10 mutant colonies were randomly picked for DNA sequencing analysis from each regional library. For the PpuMI-library, the average mutation rate per mutant is 2.8 mutations (n=9). The average mutation rate per mutant is 2.0 mutations in the 4BR1-library (n=8). Finally, sequencing data from the Rsr II library revealed an average mutation rate of 2.2 mutations per mutant (n=10). Neither insertions nor deletions were observed in any of the three libraries. All types of base substitutions were detected, however, indicating lack of bias for any specific mutation type.

Example 4

Screening Assay Development

A screening assay was developed, wherein a $B_{12}$-dependent dehydratase reaction could be manually "started" by the addition of $B_{12}$ coenzyme and substrate (glycerol). The dehydratase reaction product, 3-HP, is detected by a colorimetric aldehyde assay. Using this assay, preliminary analyses concerning the time course of typical $B_{12}$-dependent dehydratase reactions in the presence of glycerol and 1,3-propanediol allowed development of a rapid theoretical technique to estimate the initial rate of the reaction, v, and the observed enzyme inactivation rate, $k_{inact\ obsd}$.

Screening Assay Rationale

Cultures expressing either wild-type $B_{12}$-dependent dehydratase or mutant $B_{12}$-dependent dehydratase produce apo-$B_{12}$-dependent dehydratase if they have no source of the enzyme's cofactor, coenzyme $B_{12}$. In contrast, holoenzyme forms spontaneously if coenzyme is added to toluene- and detergent-permeabilized whole cells. It is therefore possible to "start" a $B_{12}$-dependent dehydratase reaction by adding coenzyme, plus substrate, to such cells. The reaction product, 3-HP, can be detected by a colorimetric aldehyde assay (Zurek, G., Karst, U. Analytica Chimica Acta, 351:247-257 (1997)) using the reagent 3-methyl-2-benzothiazolinone (MBTH) and an oxidant, ferric chloride.

Preliminary Assays to Examine the Time Course of Typical GDH Reactions (With and Without 1,3-propanediol)

Cells producing wild-type GDH were grown overnight in 15% Lennox broth (made by diluting 15 volumes of Lennox broth (Gibco-BRL, Rockville, Md.) with 85 volumes of 0.5% NaCl, followed by sterilization) at 37° C. with shaking (250 rpm) in an Innova 4300 incubator (New Brunswick Scientific, New Brunswick, N.J.). Cells were permeabilized as follows: aliquots of culture (0.3 mL) were dispensed into the square wells of a polypropylene deep-well plate (Beckman-Coulter, Fullerton, Calif.) and 10 µL of toluene containing 2.5% (v/v) Triton X-100 detergent was added to each well. Plates were then shaken for 10 min at top speed on an IKA MTS4 shaker (IKA-Werke Gmbh., Staufen, Germany). Working under red light to protect the coenzyme $B_{12}$, reactions were started by adding 5 volumes of substrate solution to 1 volume of permeabilized cell suspension. The substrate solution contained 12 mM glycerol and 24 µM coenzyme $B_{12}$ in 0.1 M K-Hepes, pH 8. At timed intervals, 12.5 µl aliquots of the reaction were added to the wells of a 96-well plate which contained 12.5 µl of 3 mg/mL MBTH in 0.4 M glycine-HCl, pH 2.7. At least 20 min after sampling, 125 µL of 5.5 mM $FeCl_3$ in 10 mM HCl was added to each of the MBTH-containing samples. After a further 20 min or longer, the blue color associated with GDH activity was quantitated as absorbance at 670 nm using a Spectramax 160 plate reader (Molecular Devices, Sunnyvale, Calif.). A similar experiment was conducted in which the substrate solution was supplemented with 50 mM 1,3-propanediol.

Theoretical Analysis of Assay Results

Data from the time course reactions were plotted as time versus $OD_{670}$, as shown in FIG. 1. Specifically, the upper trace in FIG. 1 shows the time course of the GDH reaction (room temperature, in 0.1 M K-HEPES, pH 8) with 10 mM glycerol ($K_m$ ~0.5 mM) as substrate. The rate of product formation decreases rapidly with time as inactivation occurs. A theoretical curve was drawn through the points by fitting three parameters to the following equation $y=T_0+amp(1-exp(-k_{inact\ obsd}*time))$. These paramters were: 1.) a background ($t=0$ ($T_0$)) value for the assay; 2.) an amplitude value (amp) for the limiting total absorbance produced during the assay; and 3.) a first-order inactivation rate constant ($k_{inact\ obsd}$), which controls the curvature. The fitting parameters are related to the kinetic properties of the reaction as follows: the amplitude is equal to the initial rate of the reaction (v) divided by the observed enzyme inactivation rate ($k_{inact\ obsd}$). The initial rate is $[GDH][gly]k_{cat}/(K_m+[gly])$. If the assay background is subtracted, further analysis reveals that:

1. Both v and $k_{inact\ obsd}$ can be estimated from only two samples taken during the reaction: an early point (T1) for estimation of v, and a late point (T2) for the amplitude; and
2. $1/k_{inact\ obsd}$ can be estimated as T2/T1.

The lower trace of FIG. 1 shows the effect of including 50 mM 1,3-propanediol ($K_i$~15 mM) in the assay. The initial rate of the reaction is reduced only ~20%, but inactivation was ~3 times faster. This is because, although the competitive inhibition is modest, the rate constant for inactivation of enzyme-1,3-propanediol complexes ($k_{inact\ 1,3-propanediol}$) is greater than that for enzyme-glycerol complexes ($k_{inact\ glycerol}$).

A kinetic scheme, which incorporates both inactivation processes, is shown below.

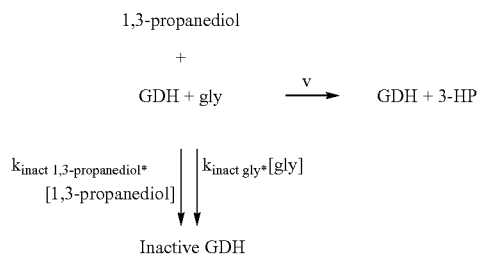

Example 5

Two-Point High Throughput Screening Assay

Mutant colonies prepared in EXAMPLES 1, 2, and 3 were examined using a high throughput screening assay protocol that was based on the methodology described in EXAMPLE 4. This assay specifically measured the GDH reaction product at two time-points during the assay: T1, measured at 30 sec after $T_0$; and T2, measured at 40 min after $T_0$.

Colonies from plated libraries were picked into 94 wells in a standard 96-well micro-titer plate containing 0.15 mL/well of 15% Lennox broth. The remaining two wells were inoculated with cells producing wild-type GDH, and the cells were allowed to grow at 37° C. in a static incubator for 4-6 hr. Alternatively, if storage of the picked cells at −80° C. before screening was desired, the medium also included glycerol (10% v/v), and the picked cells were allowed to grow overnight before being stored. Before screening, previously frozen cells were transferred with a 96-pin inoculator (V&P Scientific, San Diego, Calif.) into fresh 96-well plates containing 15% Lennox broth without glycerol and allowed to grow for 6-16 hr at 37° C. without shaking.

For GDH mutant screening, the cell growth protocol was as follows: 15% Lennox broth medium was dispensed (0.3 mL/well) into the wells of polypropylene deep-well 96-well plates (Beckman-Coulter, Fullerton, Calif.). Cells were inoculated from the shallow 96-well plates into the deep wells using a 96-pin long-pin inoculator (V&P Scientific), and the plate was covered with 3" wide Micropore surgical tape (3M Health Care, St. Paul, Minn.). The shallow 96-well plates were stored at 4° C. until the assays' completion, when they were used as a source of viable cells for further examination of lines identified as potentially improved. The cells in the deep-well plates were allowed to grow with shaking (250 rpm) at 37° C. overnight. The air in the incubator (Innova 4300, New Brunswick Scientific, New Brunswick, N.J.) was humidified with a wet sponge in a plastic tray.

Cells were permeabilized in the 96-well plates by adding 10 µL of toluene containing 2.5% (v/v) Triton X-100 detergent to each well. Plates were then shaken for 10 min at top speed on an IKA MTS4 shaker (IKA-Werke Gmbh., Staufen, Germany). Aliquots (8 µL) of permeabilized cells were transferred into 96-well reaction plates using a Biomek 2000 robot (Beckman-Coulter), located in a Plexiglas® (Rohm and Haas, Philadelphia, Pa.) enclosure covered in red plastic film to protect the substrate mixture from white room light. Reaction at room temperature was initiated by robotic addition to the cells of 40 µL of substrate mixture (prepared under red light, and stored at −20° C. in foil-wrapped containers until needed) containing 24 µM coenzyme $B_{12}$, 12 mM glycerol, and 50 mM 1,3-propanediol in 0.1 M potassium-HEPES buffer, pH 8. Thirty seconds after substrate addition, a 12.5 µL aliquot of the reaction (the T1 sample) was transferred into a second plate whose wells contained 12.5 µL of 3-methyl-2-benzothiazolinone (MBTH) in 0.4 M glycine-HCl, pH 2.7. Approximately 40 minutes after substrate addition, a similar aliquot of the reaction (the T2 sample) was transferred to a third plate containing MBTH. At least 20 min after this transfer, 125 µL of a solution of 5.5 mM $FeCl_3$ in 10 mM HCl was added to each well of the second and third (MBTH-containing) plates. After a further 20-60 min, the blue color associated with GDH activity was quantitated as absorbance at 670 nm using a Spectramax 160 plate reader (Molecular Devices, Sunnyvale, Calif.).

Data from the plate reader were transferred to a modified Microsoft® (Redmond, Wash.) Excel computer program.

The program was formated to match the first (T1) and second (T2) samples from each reaction plate and to prepare output as tables of results showing plate, location within plate, and T1, T2, and T2/T1 ratio for each reaction. The data were examined for samples showing exceptionally high values for T1, T2, or T2/T1 ratio. This was facilitated by the ability of the program to sort the data by any of these parameters. The most promising candidates were streaked out from the retained shallow 96-well plates for further examination.

Example 6

Screening the GDH Mutant Libraries and Identifying Positive Hits

Using the automated high throughput assay described in EXAMPLE 5, approximately 100,000 mutant colonies from 5 mutant libraries were screened. These libraries included:
1.) the Xba library, targeting the α-, β-, and γ-subunits (DhaB1, DhaB2, and DhaB3), as described in EXAMPLE 1;
2.) the Sma library, targeting the α- and a small portion of the α-subunits, as described in EXAMPLE 2;
3.) the PpuMI library, targeting a.a.141-a.a.152 of the α-subunit, as described in EXAMPLE 3;
4.) the 4BR1 library, targeting a.a.219-a.a.226 of the α-subunit, as described in EXAMPLE 3; and
5.) the RsrII library, targeting a.a.330-a.a.342 of the α-subunit, as described in EXAMPLE 3.

All individual isolates were derived from 1 of the 5 libraries described above. Most individual isolates were uniquely identified by a label indicating the source library, followed by a number (e.g. "Xba3010"). All putative "hits" from the first screen were confirmed in follow-up assays. Most mutational effects were classified according to 4 broad categories based on kinetic parameters as described below. Sequence analysis of the mutant genes, followed by comparison with the wild-type gene, permitted identification of the specific point mutations present in each mutant gene.

Screening the Mutant Libraries and Confirming the Hits

Following the primary screening of approximately 100,000 mutants, putative hits were confirmed by a follow-up confirmation assay. Briefly, each putative hit was re-assayed in 8 wells. Results from each individual clone were analyzed statistically to obtain the mean and standard deviation for T1 (the amount of aldehyde measured at 30 sec) and T2 (the amount of aldehyde measured at 40 min). These results were compared to the wild-type enzyme.

Figure 2:
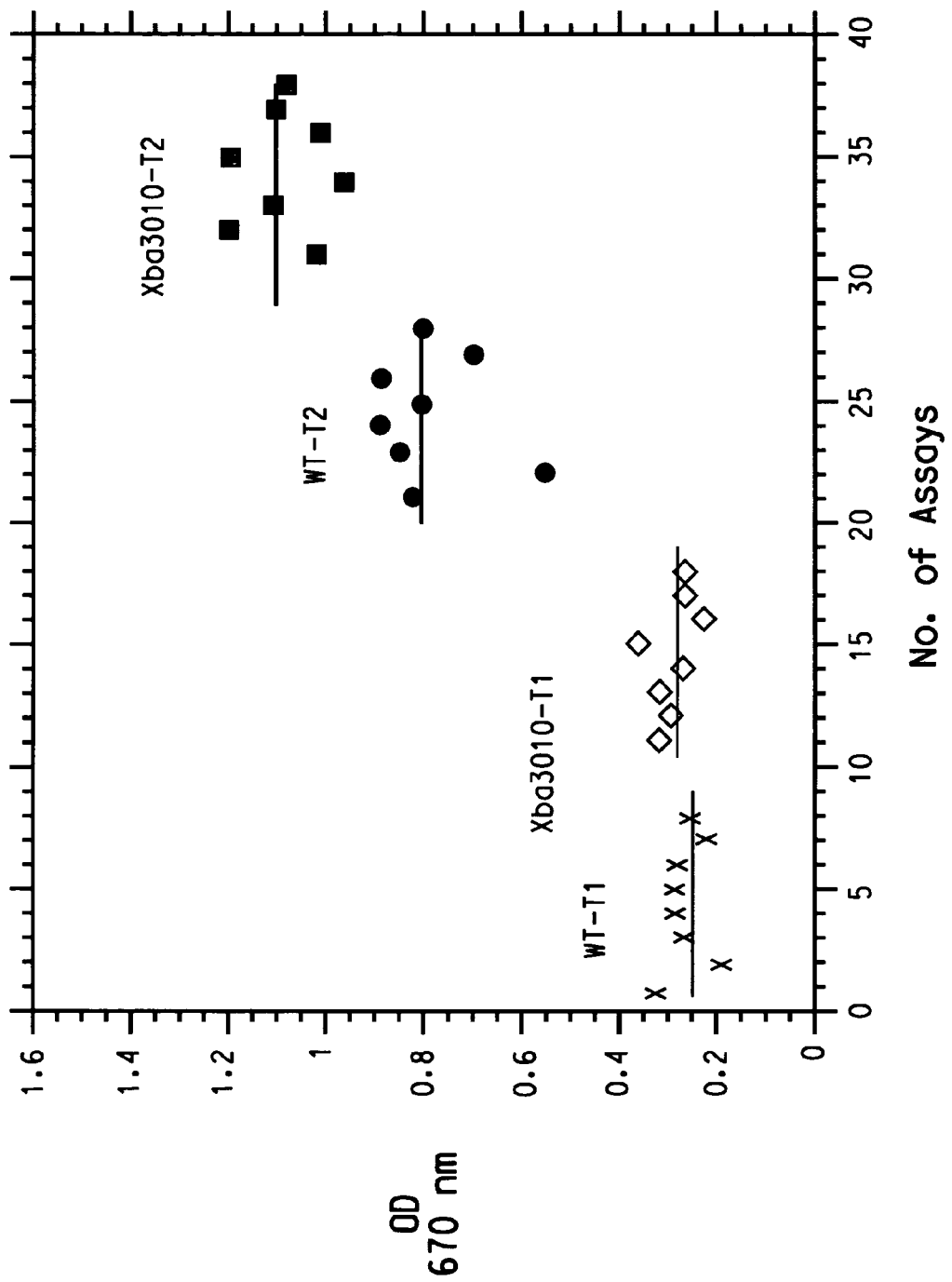

FIG. 2 shows a typical follow-up assay result, plotting the number of assays on the x-axis versus the $OD_{670nm}$ on the y-axis. Results from each individual assay (n=8) at T1 and T2 for clone Xba3010 and the wild-type are presented. The mean value is graphically shown as a horizontal line, and numerically presented in parentheses +/− standard deviation. Generally, the standard deviation was about 10-15%.

Screening Results

TABLE 6 summarizes the follow-up assay results for hits having either a T2/T1 ratio greater than that of the wild-type, or a T2 greater than that of the wild-type, or both. The T2/T1 ratio provides an indication of enzyme stability during the 40 min reaction, which occurs in the presence of 1,3-propanediol and glycerol. T2 indicates the total turnover number of the enzyme before it becomes completely inactivated. The higher the T2/T1 ratio, the better the enzyme's stability. Thus, a mutant enzyme with improved stability will have a decreased rate of inactivation in the presence of glycerol and 1,3-propanediol, as compared to the wild-type enzyme.

In TABLE 6, the mean values of T1 and T2 from the follow-up assays are reported, following their normalization to the wild-type results. Most mutant enzymes are categorized as Type-1, -2, -3, or 4 mutants, based on the following definitions:
  Type 1 mutants: T2/T1 ratio is improved with respect to wild-type, while the absolute T2 value is decreased;
  Type-2 mutants: both T2/T1 ratio and T2 are improved over the wild-type, but the degree of T2 improvement is less than that of T2/T1 ratio improvement;
  Type-3 mutants: both T2/T1 ratio and T2 are improved over the wild-type, and the degree of improvement in both are similar; and
  Type-4 mutants: T2/T1 ratio is equivalent or reduced with respect to wild-type, but T2 is improved.

TABLE 6 also summarizes the specific point mutations identified in each mutant. The SEQ ID NO: of the DNA sequence of the enzyme is provided in the first column of the Table.

TABLE 6

Summary of Type-1, Type-2, Type-3, and Type-4 Mutants

| Strain | T2/T1 Ratio* | T2 value* | Mutation(s) |
|---|---|---|---|
| Wild-type (control) (SEQ ID NO:1) | 1 | 1 | none |
| Type 1 | | | |
| Xba3007 (SEQ ID NO:40) | 4.30 | 0.78 | ACC(γ-Thr53) to GCC(Ala) |
| Xba3029 (SEQ ID NO:44) | 3.24 | 0.91 | CTC(α-Leu509) to TTC(Phe) |
| Xba3004 (SEQ ID NO:48) | 2.88 | 0.63 | ATG(α-Met306) to CTG(Leu); ACT(β-Thr45) to GCT(Ala); AAC(βAsn155) to AGC(Ser) |
| Xba3025 (SEQ ID NO:52) | 2.77 | 0.84 | ATC(γ-Ile49) to ACC(Thr) |
| Xba3038 (SEQ ID NO:56) | 2.24 | 0.58 | TTT(α-Phe233) to CTT(Leu) |
| Xba3030 (SEQ ID NO:60) | 2.00 | 0.59 | ATG(α-Met257) to GTG(Val) |
| Xba3006 (SEQ ID NO:64) | 1.97 | 0.51 | GTG(α-Val44) to GCG(Ala); ACC(α-Thr470) to GCC(Ala) |
| Xba3031 (SEQ ID NO:68) | 1.92 | 0.64 | GTC(α-Val226) to GCC(Ala) |
| Xba3017 (SEQ ID NO:72) | 1.90 | 0.69 | ATC(α-Ile105) to ATT(Ile); TCA(α-Ser168) to CCA(Pro) |
| Xba3005 (SEQ ID NO:76) | 1.84 | 0.72 | ATC(α-Ile67) to GTC(Val); GAG(α-Glu209) to GAA(Glu); AAC(β-Asn155) to AAG(Lys) |
| Xba3033 (SEQ ID NO:80) | 1.75 | 0.72 | ATG(α-Met257) to ACG(Thr); GAC(β-Asp181) to GGC(Gly) |
| Xba3032 (SEQ ID NO:84) | 1.60 | 0.91 | TAC(α-Tyr70) to AAC(Asn); GTG(α-Val86) to GAG(Glu) |
| Xba3018 (SEQ ID NO:88) | 1.60 | 0.79 | TAC(α-Tyr70) to AAC(Asn); GTT(α-Val74) to GTC(Val) |
| Xba3014 (SEQ ID NO:92) | 1.57 | 0.66 | CCG(α-Pro430) to TCG(Ser); GAA(β-Glu25) to GAG(Glu); AAA(γ-Lys27) to AGA(Arg) |
| Xba3024 (SEQ ID NO:96) | 1.44 | 0.84 | GTG(α-Val44) to GAG(Glu); GTG(α-Val461) to GGG(Gly) |
| Xba3026 (SEQ ID NO:100) | 1.43 | 0.93 | ACC(α-Thr350) to GCC(Ala) |
| Sma3009 (SEQ ID NO:104) | 2.75 | 0.71 | ATG(α-Met62) to GTG(Val); ATC(α-Ile63) to GTC(Val); AAA(α-Lys149) to AGA(Arg) |
| Sma3010 (SEQ ID NO: 108) | 2.03 | 0.96 | ATG(α-Met62) to GTG(Val); GCG(β-Ala53) to GTG(Val) |
| Sma3014 | 1.84 | 0.73 | CAG(α-Gln59) to CGG(Arg); |

TABLE 6-continued

Summary of Type-1, Type-2, Type-3, and Type-4 Mutants

| Strain | T2/T1 Ratio* | T2 value* | Mutation(s) |
|---|---|---|---|
| (SEQ ID NO:112) | | | ATT(α-Ile314) to GTT(Val); TTT(β-Phe11) to TTA(Leu) |
| Sma3008 (SEQ ID NO:116) | 1.75 | 0.95 | ATG(α-Met62) to ACG(Thr); CTG(α-Leu268) to CTA(Leu) |
| Sma3001 (SEQ ID NO:120) | 1.56 | 0.97 | AAC(α-Asn520) to AGC(Ser) |
| PpuMI001 (SEQ ID NO:124) | 2.43 | 0.57 | CGG(α-Arg137) to AGG(Arg); TGC(α-Cys143) to TGT(Cys); CTC(α-Leu148) to CGC(Arg); CCG(α-Pro152) to CCC(Pro) |
| PpuMI002 (SEQ ID NO:128) | 2.08 | 0.69 | CGG(α-Arg137) to AGG(Arg); GAT(α-Asp150) to CAT(His) |
| PpuMI005 (SEQ ID NO:132) | 1.85 | 0.81 | CGG(α-Arg137) to AGG(Arg); CAG(α-Gln242) to CAA(Gln); AAA(α-Lys149) to CAA(Gln); CCG(α-Pro152) to CCC(Pro) |
| RsrII001 (SEQ ID NO:136) | 1.92 | 0.72 | TTC(α-Phe339) to GTC(Val); CGC(α-Arg346) to CGG(Arg) |
| Type 2 | | | |
| Sma3002 (SEQ ID NO:140) | 2.73 | 1.60 | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) |
| Sma3003 (SEQ ID NO:143) | 1.95 | 1.16 | ATG(α-Met62) to CTG(Leu) |
| Xba3015 (SEQ ID NO:147) | 2.36 | 1.13 | GTT(α-Val549) to GCT(Ala); CTG(β-Leu113) to CCG(Pro); GCC(γ-Ala122) to GTC(Val); GCG(γ-Ala128) to GTG(Val) |
| Xba3008 (SEQ ID NO:151) | 2.12 | 1.15 | TCT(β-Ser122) to CCC(Pro); AAA(β-Lys166) to AGA(Arg) |
| Xba3016 (SEQ ID NO:155) | 1.72 | 1.18 | ATC(α-Ile102) to ACC(Thr) |
| Xba3020 (SEQ ID NO:159) | 1.65 | 1.04 | CCG(β-Pro152) to ACG(Thr) |
| Xba3037 (SEQ ID NO:163) | 1.48 | 1.06 | GAG(α-Glu116) to GAA(Glu); GTT(α-Val423) to ATT(Ile) |
| Xba3036 (SEQ ID NO:167) | 1.27 | 1.03 | GGT(α-Gly47) to GGC(Gly); CGA(α-Arg65) to CAA(Gln) |
| 4BR1001 (SEQ ID NO:171) | 1.90 | 1.10 | GGC(α-Gly216) to GGG(Gly); GTG(α-Val224) to CTG(Leu) |
| Type 3 | | | |
| Xba3010 (SEQ ID NO:175) | 1.25 | 1.39 | CTG(α-Leu318) to TTG(Leu); AAC(α-Asn447) to AAT(Asn); AAT(α-Asn489) to AGT(Ser); GCC(β-Ala27) to TCC(Ser) |
| Type 4 | | | |
| Xba3009 (SEQ ID NO:179) | 0.98 | 1.61 | ACG(α-Thr77) to GCG(Ala); TGC(α-Cys193) to AGC(Ser); TAA(stop of α) to GAA(Glu); AAA(β-Lys56) to AGA(Arg); GCC(β-Ala88) to GCT(Ala); GAT(β-Asp111) to GAA(Glu); CAT(γ-His67) to TAT(Tyr); ACC(γ-Thr114) to TCC(Ser) |
| Xba3023 (SEQ ID NO:182) | 1.00 | 1.22 | GGG(α-Gly63) to GGA(Gly); CAC(α-His96) to CAT(His); ATC(α-Ile102) to GTC(Val) |
| Other | | | |
| KG002 (SEQ ID NO:241) | 1.03 | 1.22 | CTG(β-Leu113) to CCG(Pro); ACC(γ-Thr114) to GCC(Ala); GCT(α-Ala309) to GCC(Ala); AAC(α-Asn468) to AAT(Asn) |
| KG003 (SEQ ID NO:245) | 1.05 | 0.92 | GTG(α-Val224) to ATG(Met); CCG(α-Pro450) to CCA(Pro) |
| KG004 (SEQ ID NO:249) | 1.53 | 1.14 | GTC(α-Val226) to GCC(Ala); ATG(α-Met306) to TTG(Leu) |
| KG005 (SEQ ID NO:253) | 1.62 | 1.33 | ACT(α-Asn288) to ACC(Asn); ATG(α-Met306) to TTG(Leu); CCG(β-Pro152) to TCG(Ser) |
| KG006 (SEQ ID NO:257) | 1.09 | 1.22 | ATG(α-Met62) to ACG(Thr) |
| KG007 (SEQ ID NO:261) | 1.11 | 1.16 | GTC(α-Val115) to GCC(Ala); CTG(β-Leu13) to CCG(Pro) |
| KG010 (SEQ ID NO:265) | 1.15 | 1.06 | AAT(α-Asn151) to AAC(Asn); TTC(α-Phe513) to CTC(Leu) |
| KG011 (SEQ ID NO:269) | 1.35 | 1.03 | ATG(α-Met214) to TTG(Leu); GCG(α-Ala460) to GCA(Ala); GAA(α-Glu462) to GAG(Glu); ACC(α-Thr499) to GCC(Ala); GAT(β-Asp24) to GGT(Gly); GAA(β-Glu29) to GAG(Glu); CTG(β-Leu58) to CTT(Leu); CGG(β-Arg70) to CGA(Arg); GAG(β-Glu130) to GGG(Gly); AAA(γ-Lys4) to AAG(Lys) |
| KG012 (SEQ ID NO:273) | 1.15 | 1.01 | TTA(α-Leu217) to GTA(Val) |
| KG014 (SEQ ID NO:277) | 1.1 | 0.95 | ATG(α-Met62) to GTG(Val); GAT(β-Asp24) to GAA(Glu) |
| KG016 (SEQ ID NO:281) | 0.97 | 1.02 | CGG(α-Arg137) to AGG(Arg); AAC(α-Asn141) to ATC(Ile); GAT(α-Asp150) to GAC(Asp); GCG(α-Ala231) to ACG(Thr); GGC(α-Gly236) to AGC(Ser) |
| KG017 (SEQ ID NO:285) | 0.93 | 1.05 | TCA(α-Ser41) to TCG(Ser); GCG(α-Ala119) to ACG(Thr); AAC(α-Asn447) to AAT(Asn) |
| KG021 (SEQ ID NO:289) | 1.29 | 0.93 | GTC(α-Val226) to GCC(Ala) |
| KG023 (SEQ ID NO:293) | 1.21 | 0.88 | CCG(β-Pro152) to TCG(Ser) |
| KG001 (SEQ ID NO:297) | 5.7 | 0.80 | AGC(α-Ser219) to AAC(Asn) |

*The T2/T1 ratio and T2 value are relative numbers normalized to the wild-type.

As seen from the sequencing results, most mutations were identified as amino acid substitutions (with the exception of the silent mutations). However, two of the mutants (Sma3002 [SEQ ID NO:140] and Xba3009 [SEQ ID NO:179]) were fusion proteins. Specifically, the stop codon (TM) of the gene encoding the α-subunit (dhaB1) was changed to CM (Gln) or GM (Glu) in Sma3002 and Xba3009, respectively. Since there are 15 bp between this stop codon and the initial codon of the gene encoding the β-subunit (dhaB2), neither of these fusion proteins caused frame shifts to occur in the β-subunit. This permitted both mutant enzymes to retain activity. The initial codon (GTG) of the β-subunit is usually recognized by fMet-tRNA; however, in the fusion mutants, this codon should be recognized by Val-tRNA. The Sma3002 fusion protein contained a linker that consists of six amino acid residues: Gln-Gly-Gly-Ile-Pro-Val (SEQ ID NO:18). For the Xba3009 fusion protein, the linker was Glu-Gly-Gly-Ile-Pro-Val (SEQ ID NO:19).

Example 7

Biochemical Analysis of the Mutants Using Purified Enzyme

Better characterization of five mutants and the wild-type GDH was accomplished following each enzyme's over-expression and purification.

Over-Expression and Purification

Xba3007 (Type-1; SEQ ID NO:40), Sma3002 (Type-2; SEQ ID NO:140), Xba3010 (Type-3; SEQ ID NO:175), Xba3009 (Type-4; SEQ ID NO:179) and 4BR1001 (Type-2; SEQ ID NO:171)) were selected for further biochemical analysis, along with the wild-type enzyme. First, plasmids were purified from the 5K(DE3) *E. coli* host strain, and transformed into *E. coli* BL21 (DE3). The cells were grown in LB medium containing ampicillin to an $OD_{600}$ of 0.6-1.0 before 1.0 mM IPTG was added. After 3 hr of induction at 37° C., cells were harvested by centrifugation and washed once with 20 mM HEPES-KOH buffer (pH 8.0). The cell pellets were stored at −80° C.

For enzyme purification, the cell pellets were first resuspended in 20 mM HEPES-KOH buffer (pH 8.0) containing a Complete Mini protease inhibitor cocktail tablet (Roche, Polo Alto, Calif.) and 0.5 mM EDTA. The cells were broken by sonication (Branson model 450; 20% output, 50% pulse, 4 min in ice bath), followed by centrifugation (40,000×g, 30 min, 4° C.). The clear supernatants were spun again (110,000×g, 1 hr, 4° C.), and $(NH_4)_2SO_4$ was slowly added into the supernatant on ice to bring the solution to 50% saturation. The solutions were stirred for 25 min on ice, followed by centrifugation (40,000×g, 30 min, 4° C.). The pellets were resuspended in 2 mL of running buffer (100 mM HEPES-KOH (pH 8.2), 100 mM 1,2-propanediol and 1 mM DTT), and then applied to a 16/60 Hiload Superdex200 size exclusion column (Pharmacia Biotech, Piscataway, N.J.) equilibrated with the running buffer.

The enzymes were eluted with running buffer at a flow rate of 0.25 mL/min, and the eluents were collected using a fraction collector (3 mL/fraction). Fractions were assayed for enzyme activity using the assay described in EXAMPLE 5, and then the active fractions were pooled and concentrated using Centricon YM100 (Milipore, Bedford, Mass.). The concentrated enzymes were passed over the same column an additional time using fresh running buffer consisting of 100 mM HEPES-KOH (pH 8.2) and 1 mM DTT. The purified enzymes were 75-95% pure, as judged by SDS-PAGE electrophoresis using a 10-20% gradient gel and Coomassie blue staining.

Biochemical Characterization of the Mutant GDH Enzymes:

Detailed enzyme kinetic analyses using the purified wild-type and mutant GDH enzymes were conducted. The enzyme activity was determined by measuring product formation using the MBTH-colorimetric aldehyde assay (Zurek, G., Karst, U. *Analytica Chimica Acta,* 351:247-257 (1997)), and the $K_M$ and $V_{max}$ were determined from Lineweaver-Burke plots. The $k_{cat}$ was calculated from $V_{max}$. The determined $K_M$ and $k_{cat}$ of the enzymes are shown in TABLE 7.

TABLE 7

$K_M$ and $k_{cat}$ of wild-type and Selected Mutant GDH enzymes

| Enzyme | $K_M$ (mM) | $k_{cat}$ (min$^{-1}$) |
|---|---|---|
| WT | 2.56 | 29,000 |
| Sma3002 (Type 2) | 2.94 | 9,830 |
| 4BR1001 (Type 2) | 2.00 | 15,729 |
| Xba3007 (Type 1) | 20.00 | 16,220 |
| Xba3009 (Type 4) | 3.13 | 65,373 |
| Xba3010 (Type 3) | 3.23 | 28,017 |

Finally, a detailed analysis of each mutant enzyme's inactivation properties was performed. The glycerol inactivation rate constant was measured as described in EXAMPLE 4. To measure the air inactivation rate constant, the enzyme was diluted to 27 μg/mL in 0.1 M K-HEPES buffer (pH 8) containing 21 μM coenzyme $B_{12}$, and then incubated in air at room temperature. The total turnover number was measured after 0.25, 0.5, 1, 2, 5, 10, 15, 20 and 30 min incubation. To measure the total turnover number, 10 μL of the enzyme solution was added to 190 μL reaction solution containing 200 mM glycerol, 24 mM coenzyme $B_{12}$ and 0.1 M K-HEPES buffer (pH 8), and the reaction mixture was incubated at room temperature for 2 hr. The total turnover number was estimated by measuring 3-HP concentration using the MBTH-colorimetric aldehyde assay (Zurek, G. and Karst, U., supra). The data was plotted as time versus total turnover number, and the air inactivation rate constant was estimated by curve-fitting using the equation $A=A_0 \exp(-k_{air} t)$, where: "A" is the total turnover number, "$A_0$" is the total turnover number at time zero, "$k_{air}$" is the air inactivation rate constant, and "t" is time.

To measure 1,3-propanediol inactivation, the enzyme was diluted to 27 μg/mL in 0.1 M K-HEPES buffer (pH 8) containing 21 μM coenzyme $B_{12}$ and various concentrations of 1,3-propanediol (i.e., 1, 20, 100 and 300 mM). For each 1,3-propanediol concentration, the inactivation rate constant was estimated by the method used for measuring the air inactivation rate constant. The inactivation rate constants were plotted against 1,3-propanediol concentration, and the maximum inactivation rate constant by 1,3-propanediol was estimated from the curve. The dissociation constant for 1,3-propanediol was the 1,3-propanediol concentration at which the inactivation rate constant was half of the maximum inactivation rate constant.

Results from this analysis of inactivation properties are shown below in TABLE 8. In the absence of either glycerol or 1,3-propanediol or light, but in the presence of air (oxygen), inactivation of $B_{12}$-dependent dehydratase holoenzymes occur with bi-phasic kinetics. $k_{gly}$ is the inactivation rate constant measured in the presence of 10 mM glycerol without 1,3-propanediol. All of the mutant and wild-type dehydratases showed a biphasic air inactivation; thus, $k_{air}$, F is the air inactivation rate constant for the fast phase and $k_{air}$, s is the air inactivation rate constant for the slow phase. $k_{1,3}$-propanediol is the maximum inactivation rate constant by 1,3-propanediol. $K_d$ is the dissociation constant for 1,3-propanediol.

TABLE 8

Inactivation properties of Selected Mutant enzymes

| Strain | $k_{gly}$ (min$^{-1}$) | $k_{air, F}$ (min$^{-1}$) | $k_{air, S}$ (min$^{-1}$) | $k_{1,3\text{-}propanediol}$ (min$^{-1}$) | $K_d$ (mM) |
|---|---|---|---|---|---|
| WT GDH | 0.43 | 0.35 | 0.03 | 1.99 | 41 |
| Sma3002 | 0.13 | 0.04 | 0.02 | 0.76 | 39 |
| 4BR1001 | — | 0.10 | 0.03 | 1.02 | 16 |
| Xba3007 | 0.03 | 0.05 | 0.01 | 0.41 | 40 |
| Xba3009 | 0.33 | 0.11 | 0.03 | 2.76 | 20 |
| Xba3010 | 0.45 | — | — | — | — |

Example 8

Second Round Mutagenesis by Combination of Selected First Generation Mutants To further improve the mutants obtained from the first round of mutagenesis, a second round of mutagenesis was performed to combine mutations from several first generation mutants.

To make the second generation mutants, plasmids from several first generation mutants containing multiple mutations (e.g., Sma3002 or Xba3009) were first purified from the host cells. The single point mutation found in Xba3007, Xba3029 or 4BR1001 was then introduced into these plasmids, to produce second generation mutants 2-F4, 12-B1, 13-B7, and 16-H5. TABLE 9 summarizes the details concerning each of these mutants and the primers used to produce them. The nucleotide shown in capitalized, boldface lettering in each primer shows the location of the specific mutation to be introduced.

TABLE 9

Synthesis of Second Generation Mutants

| 2$^{nd}$ Generation Mutant | "Parent" Mutants | Forward Primer | Reverse Primer |
|---|---|---|---|
| 2-F4 | Sma3002 + 4BR1001 | 2-F4-F1: 5'-c tac gcc gag acg Ctg tcg gtc tac ggc-3' (SEQ ID NO:20) | 2-F4-R1: 5'-gcc gta gac cga caG cgt ctc ggc gta g-3' (SEQ ID NO:21) |
| 12-B1 | Xba3009 + Xba3007 | 12-B1-F1: 5'-gga tct ccc gcc agG ccc ttg agt acc-3' (SEQ ID NO:22) | 12-B1-R1: 5'-ggt act caa ggg Cct ggc ggg aga tcc-3' (SEQ ID NO:23) |
| 13-B7 | Sma3002 + Xba3007 | 12-B1-F1: 5'-gga tct ccc gcc agG ccc ttg agt acc-3' (SEQ ID NO:22) | 12-B1-R1: 5'-ggt act caa ggg Cct ggc ggg aga tcc-3' (SEQ ID NO:23) |
| 16-H5 | Sma3002 + Xba3029 | 16-H5-F1: 5'-cag acc tcg gcc att Ttc gat cgg cag ttc gag-3' (SEQ ID NO:24) | 16-H5-R1: 5'-ctc gaa ctg ccg atc gaA aat ggc cga ggt ctg-3' (SEQ ID NO:25) |

Mutagenesis experiments were performed using Stratagene QuikChange site-directed mutagenesis kits (Stratagene, La Jolla, Calif.), as described in EXAMPLE 3.

The T2/T1 ratio and T2 value for each of the second generation mutants was determined, as previously described in EXAMPLE 5. These results are shown below in TABLE 10. The SEQ ID NO: of the DNA sequence of the enzyme is provided in the first column of the Table.

TABLE 10

T2/T1 Ratio and T2 Value of Second Generation mutants

| Mutant | Mutation | T2/T1 ratio* | T2* |
|---|---|---|---|
| WT (SEQ ID NO:1) | — | 1 | 1 |
| Sma3002 (SEQ ID NO:140) | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) | 2.7 | 1.6 |
| Xba3007 (SEQ ID NO:40) | ACC(γ-Thr53) to GCC(Ala) | 4.3 | 0.8 |
| Xba3009 (SEQ ID NO:179) | ACG(α-Thr77) to GCG(Ala); TGC(α-Cys193) to AGC(Ser); TAA(stop of α) to GAA(Glu); AAA(β-Lys56) to AGA(Arg); GCC(β-Ala88) to GCT(Ala); GAT(β-Asp111) to GAA(Glu); CAT(γ-His67) to TAT(Tyr); ACC(γ-Thr114) to TCC(Ser) | 1.0 | 1.6 |
| Xba3029 (SEQ ID NO:44) | CTC(α-Leu509) to TTC(Phe) | 3.4 | 0.9 |
| 4BR1001 (SEQ ID NO:171) | GGC(α-Gly216) to GGG(Gly); GTG(α-Val224) to CTG(Leu) | 1.9 | 1.1 |
| 2-F4 (SEQ ID NO:186) | GTG(α-Val224) to CTG(Leu); TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) | 14.4 | 0.5 |
| 12-B1 (SEQ ID NO:189) | ACG(α-Thr77) to GCG(Ala); TGC(α-Cys193) to AGC(Ser); TAA(stop of α) to GAA(Glu); AAA(β-Lys56) to AGA(Arg); GCC(β-Ala88) to GCT(Ala); GAT(β-Asp111) to GAA(Glu); ACC(γ-Thr53) to GCC(Ala); CAT(γ-His67) to TAT(Tyr); ACC(γ-Thr114) to TCC(Ser) | 4.6 | 1.8 |
| 13-B7 (SEQ ID NO:192) | TAT(α-Tyr271) to TGT(Cys); TAC(α-Tyr502) to CAC(His); TAA(stop of α) to CAA(Gln); CAA(β-Gln2) to CGA(Arg); TTT(β-Phe10) to TTC(Phe); ACC(γ-Thr53) to GCC(Ala) | 2.4 | 0.8 |
| 16-H5 (SEQ ID NO:195) | TAT(γ-Tyr271) to TGT(Cys); TAC(α-Tyr502) to CAC(His); CTC(α-Leu509) to TTC(Phe); TAA(stop of α) to CAA(Gln); CAA(β-Gln2) to CGA(Arg); TTT(β-Phe11) to TTC(Phe) | 16.8 | 1.2 |

*The T2/T1 ratio and T2 value are relative numbers, normalized to the wild-type enzyme. Those mutants shown in bold text are second generation mutants.

Example 9

Construction and Analysis of the Pure Fusion Mutants

Two fusion mutants, Xba3009 (SEQ ID NO:179) and Sma3002 (SEQ ID NO:140), were described in EXAMPLE 6. Both contained other mutations, in addition to the fusion itself. In order to investigate the effects of the α- and β-fusion, two pure fusion mutants (1E1 and 20G7) were constructed.

Construction of Pure Fusion Mutants

The stop codon of the α-subunit (TM) was changed to CM (1E1) or GM (22-G7). This modification was achieved by introducing the single point mutation into the wild-type GDH plasmid. The following two pairs of primers were used for making the point mutations:

For the 1-E1 mutant:

1-E1-F1: 5'-gac acc att gaa Caa ggc ggt att cct-3' (SEQ ID NO:26)

1-E1-R1: 5'-agg aat acc gcc ttG ttc aat ggt gtc-3' (SEQ ID NO:27)

For the 22-G7 mutant:

22-G7-F1:
5'-ccc gac acc att gaa Gaa ggc ggt att cct gtg-3' (SEQ ID NO:28)

22-G7-R1:
5'-cac agg aat acc gcc ttC ttc aat ggt gtc ggg-3' (SEQ ID NO:29)

The nucleotide shown in capitalized, boldface lettering in each primer shows the location of the specific mutation to be introduced.

Mutagenesis experiments were carried out using a Stratagene QuikChange site-directed mutagenesis kit (Stratagene, La Jolla, Calif.), as described in EXAMPLE 3. The T2/T1 ratio and T2 value of these two mutants were measured as described in EXAMPLE 5. These results are shown in TABLE 11. The SEQ ID NO: of the DNA sequence of the enzyme is provided in the first column of the Table.

TABLE 11

T2/T1 Ratio and T2 Value of Pure Fusion Mutants

| Mutant | Mutation | T2/T1 ratio* | T2* |
| --- | --- | --- | --- |
| WT | — | 1 | 1 |
| 1-E1 (SEQ ID NO:198) | TAA(stop of α) to CAA(Gln) | 0.72 | 1.82 |
| 22-G7 (SEQ ID NO:201) | TAA(stop of α) to GAA(Glu) | 0.75 | 1.79 |

*The T2/T1 ratio and T2 value are relative numbers, normalized

Example 10

Analysis of the Mutations Found in Mutant Sma3002

Sma3002 (SEQ ID NO:140), a first generation mutant identified in EXAMPLE 6, displayed significant improvements in both T2/T1 ratio and T2 value. It contained four point mutations, one of which included the fusion mutation explored in detail in EXAMPLE 9. To investigate the effect of these mutations individually, two more mutants (α-Y271C and β-Q2R) were constructed.

Using methodology previously followed, single point mutations were introduced into the wild-type plasmid using uniquely designed primers, as shown below. As in previous EXAMPLES, the nucleotide shown in capitalized, boldface lettering in each primer shows the location of the specific mutation to be introduced.

TABLE 12

Synthesis of Sma3002-Derived Mutants, Each Mutant Containing a Single Point Mutation Found in Sma3002

| Mutant | Mutation | Forward Primer | Reverse Primer |
| --- | --- | --- | --- |
| 7A-C1 | α-Y271C | 7A-C1-F1: 5'-gcg ctg atg ggc tGt tcg gag agc aag-3' (SEQ ID NO:30) | 7A-C1-R1: 5'-ctt gct ctc cga aCa gcc cat cag cgc-3' (SEQ ID NO:31) |
| 7C-A5 | β-Q2R | 7C-A5-F1: 5'-ggc ggt att cct gtg cGa cag aca acc caa att c-3' (SEQ ID NO:32) | 7C-A5-R1: 5'-g aat ttg ggt tgt ctg tCg cac agg aat acc gcc-3' (SEQ ID NO:33) |

Mutagenesis experiments were carried out using Stratagene QuikChange site-directed mutagenesis kits (Stratagene, La Jolla, Calif.), as described in EXAMPLE 3. The T2/T1 ratio and T2 value of these mutants were measured, as described in EXAMPLE 5. TABLE 13 shows the results. The SEQ ID NO: of the DNA sequence of the enzyme is provided in the first column of the Table.

TABLE 13

T2/T1 Ratio and T2 Value of Sma3002-Derived Mutants, Each Mutant Containing a Single Point Mutation Relative to Sma3002

| Mutant | Mutation | T2/T1 ratio* | T2* |
| --- | --- | --- | --- |
| WT (SEQ ID NO:1) | — | 1 | 1 |
| Sma3002 (SEQ ID NO:140) | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) | 2.7 | 1.6 |
| 7A-C1 (SEQ ID NO:204) | TAT(α-Tyr271) to TGT(Cys) | 1.01 | 0.43 |
| 7C-A5 (SEQ ID NO:208) | CAA(β-Gln2) to CGA(Arg) | 1.02 | 0.95 |

*The T2/T1 ratio and T2 value are relative numbers, normalized to the wild-type enzyme. Those mutants shown in bold text contain a single point mutation, derived from Sma3002.

The α-Y271C mutation decreased the T2 value, but failed to change the T2/T1 ratio. Thus, this mutation decreased the $k_{cat}$ of the enzyme. The other mutation, β-Q2R, did not appear to significantly affect either the T2 or T2/T1 ratio.

To determine whether any of the 3 non-fusion mutations in Sma3002 (SEQ ID NO:140) acted in concert to increase the enzyme's stability in the presence of 1,3-propanediol and glycerol, three additional mutants were made. In each of these mutants, one of the three non-fusion mutations in Sma3002 ((α-Y271 C, α-Y502H, or β-Q2R) was removed, by introducing the wild-type DNA sequence as a single point mutation. This resulted in three Sma3002-derived mutants, each containing 2 of the original non-fusion mutations present in Sma3002. Single point mutations were introduced into the Sma3002 plasmid, using the Stratagene QuikChange site-directed mutagenesis kit, as described in EXAMPLE 3, and the primers shown in TABLE 14 below.

TABLE 14

Synthesis of Sma3002-Derived Mutants, Each Mutant Containing Four Point Mutations Found in Sma3002

| Mutant | Mutation Removed | Forward Primer | Reverse Primer |
|---|---|---|---|
| 8-C9 | α-Y271C | 8-C9-F1 (SEQ ID NO:34) | 8-C9-R1 (SEQ ID NO:35) |
| 9-D7 | α-Y502H | 9-D7-F1 (SEQ ID NO:36) | 9-D7-R1 (SEQ ID NO:37) |
| 10-G6 | β-Q2R | 10-G6-F1 (SEQ ID NO:38) | 10-G6-R1 (SEQ ID NO:39) |

The T2/T1 ratio and T2 values of these mutants were measured as described in EXAMPLE 5. TABLE 15 shows the results of this analysis. The SEQ ID NO: of the DNA sequence of the enzyme is provided in the first column of the Table.

TABLE 15

T2/T1 Ratio and T2 Value of Sma3002-Derived Mutants, Each Mutant Containing Four Point Mutations

| Mutant | Mutation Removed | T2/T1 ratio* | T2* |
|---|---|---|---|
| WT (SEQ ID NO:1) | — | 1 | 1 |
| Sma3002 (SEQ ID NO:140) | — | 2.7 | 1.6 |
| 8-C9 (SEQ ID NO:212) | α-Y271C | 1.3 | 1.85 |
| 9-D7 (SEQ ID NO:215) | α-Y502H | 0.98 | 1.57 |
| 10-G6 (SEQ ID NO:218) | β-Q2R | 2.56 | 1.55 |

*The T2/T1 ratio and T2 value are relative numbers, normalized to the wild-type enzyme. Those mutants shown in bold text contain three mutations and were derived from Sma3002.

Example 11

Third Round Mutagenesis by Addition of Some First Generation Mutations to Second Generation Mutants Although substantial improvement was made in the previous EXAMPLES toward improving the total turnover of the GDH enzyme, as measured by values reported herein as T2, a third round of mutagenesis was performed. In these reactions, select point mutations from the first generation mutants were introduced into the two second generation mutants showing the greatest improvement in T2 values (i.e., 1-E1 and 8-C9). This was accomplished by first purifying the 1-E1 and 8-C9 mutant plasmids from the host cells. Then, the single amino acid substitution mutation found in Xba3007, Xba3029, or 4BR1001 was introduced into these plasmids, using the primers shown in TABLE 16 and the Stratagene QuikChange site-directed mutagenesis kit (Stratagene, La Jolla, Calif.), as described in EXAMPLE 3.

TABLE 16

Synthesis of Third Generation Mutants

| 3rd Generation Mutant | "Parent" Mutants | Forward Primer | Reverse Primer |
|---|---|---|---|
| 15-E4 | 8-C9 + 4BR1001 | 2-F4-F1 (SEQ ID NO:20) | 2-F4-R1 (SEQ ID NO:21) |
| 18-D7 | 8-C9 + Xba3007 | 12-B1-F1 (SEQ ID NO:22) | 12-B1-R1 (SEQ ID NO:23) |
| 21-D10 | 1-E1 + Xba3007 | 12-B1-F1 (SEQ ID NO:22) | 12-B1-R1 (SEQ ID NO:23) |
| 17-F6 | 8-C9 + Xba3029 | 16-H5-F1 (SEQ ID NO:24) | 16-H5-R1 (SEQ ID NO:25) |
| 20-B9 | 1-E1 + Xba3029 | 16-H5-F1 (SEQ ID NO:24) | 16-H5-R1 (SEQ ID NO:25) |

The T2/T1 ratio and T2 value of these third generation mutants were measured as described in EXAMPLE 5. TABLE 17 shows the results. The SEQ ID NO: of the DNA sequence of the enzyme is provided in the first column of the Table.

TABLE 17

T2/T1 Ratio and T2 Value of Third Generation Mutants

| Mutant | Mutation | T2/T1 ratio* | T2* |
|---|---|---|---|
| WT (SEQ ID NO:1) | — | 1 | 1 |
| Sma3002 (SEQ ID NO:140) | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) | 2.7 | 1.6 |
| Xba3007 (SEQ ID NO:40) | ACC(γ-Thr53) to GCC(Ala) | 4.3 | 0.8 |
| Xba3029 (SEQ ID NO:44) | CTC(α-Leu509) to TTC(Phe) | 3.4 | 0.9 |
| 4BR1001 (SEQ ID NO:171) | GGC(α-Gly216) to GGG(Gly); GTG(α-Val224) to CTG(Leu) | 1.9 | 1.1 |
| 1-E1 (SEQ ID NO:198) | Pure fusion, TAA(stop of α) to CAA(Gln) | 0.72 | 1.82 |
| 8-C9 (SEQ ID NO:212) | TAC(α-Tyr502) to CAC(His); TAA(stop of α) to CAA(Gln); CAA(β-Gln2) to CGA(Arg); TTT(β-Phe11) to TTC(Phe) | 1.30 | 1.85 |
| 21-D10 (SEQ ID NO:221) | TAA(stop of α) to CAA(Gln); ACC(γ-Thr53) to GCC(Ala) | 3.85 | 1.91 |
| 20-B9 (SEQ ID NO:225) | CTC(α-Leu509) to TTC(Phe); TAA(stop of α) to CAA(Gln) | 3.86 | 1.95 |
| 18-D7 (SEQ ID NO:229) | TAC(α-Tyr502) to CAC(His); TAA(stop of α) to CAA(Gln); CAA(β-Gln2) to CGA(Arg); TTT(β-Phe11) to TTC(Phe); ACC(γ-Thr53) to GCC(Ala) | 5.38 | 1.30 |
| 17-F6 (SEQ ID NO:233) | TAC(α-Tyr502) to CAC(His); CTC(α-Leu509) to TTC(Phe); TAA(stop of α) to CAA(Gln); CAA(β-Gln2) to CGA(Arg); TTT(β-Phe11) to TTC(Phe) | 3.63 | 1.77 |
| 15-E4 (SEQ ID NO:237) | TAC(α-Tyr502) to CAC(His); TAA(stop of α) to CAA(Gln); CAA(β-Gln2) to CGA(Arg); TTT(β-Phe11) to TTC(Phe); GTG(α-Val224) to CTG(Leu) | 3.95 | 1.66 |

*The T2/T1 ratio and T2 value are relative numbers, normalized to the wild-type. Those mutants shown in bold text are third generation mutants.

Overall, there was substantial improvement in enzyme stability in the third generation mutants. All mutants possessed improved stability (T2/T1 ratio) and total turnover number (T2), relative to the best first generation mutant (i.e., Sma3002 (SEQ ID NO:140)). In fact, mutants 20-B9 and 21-D10 had T2 values greater than all mutants previously generated.

Example 12

Biochemical Characterization of Some Second and Third Generation Mutants

To further characterize selected second and third generation mutants, the inactivation rate constants for these mutants in the presence of 10 mM glycerol and 50 mM 1,3-propanediol were determined, using the methods described in the EXAMPLE 4. These results are summarized in TABLE 18, as shown below.

TABLE 18

Inactivation Rate Constants of Some Second and Third Generation Mutants

| Mutant | T2/T1 ratio* | Inactivation rate constant (min$^{-1}$) | Decrease of Inactivation (fold) |
|---|---|---|---|
| WT | 1 | 0.85 | 1 |
| Sma3002 | 2.7 | 0.17 | 5.1 |
| 1-E1 | 0.72 | 1.06 | 0.8 |
| 8-C9 | 1.3 | 0.41 | 2.1 |
| 15-E4 | 3.95 | 0.12 | 7.1 |
| 18-D7 | 5.38 | 0.04 | 21.3 |
| 20-B9 | 3.86 | 0.11 | 7.7 |
| 21-D10 | 3.85 | 0.09 | 9.4 |

As expected, the results were consistent with the T2/T1 ratio measurements.

Since one application for improved GDHs is for 1,3-propanediol bioproduction, it is important to determine the total turnover number of the mutants in the presence of high concentrations of 1,3-propanediol. The assays described above had been performed in the presence of only 50 mM. In the late phase of fermentation for 1,3-propanediol bioproduction, the 1,3-propanediol concentration can reach up to 1 M; thus, a second two-point assay was conducted. Specifically, T2 values were also measured in the presence of 10 mM glycerol and 600 mM 1,3-propanediol for several promising mutants. TABLE 19 summarizes the results:

TABLE 19

T2 values measured in the presence of 600 mM 1,3-propanediol for Selected Second and Third Generation Mutants

| Mutant | T2$_{(600\ mM)}$ |
|---|---|
| WT (SEQ ID NO: 1) | 1 |
| Sma3002 (SEQ ID NO: 140) | 3.3 |
| 1-E1 (SEQ ID NO: 198) | 2.2 |
| 8-C9 (SEQ ID NO: 212) | 3.1 |
| 15-E4 (SEQ ID NO: 237) | 4.0 |
| 18-D7 (SEQ ID NO: 229) | 4.0 |
| 20-B9 (SEQ ID NO: 225) | 4.1 |
| 21-D10 (SEQ ID NO: 221) | 4.3 |

Results were somewhat similar to those obtained for T2$_{(50\ mM)}$, although a few mutants performed better than would have been predicted. The T2$_{(600\ mM)}$ of Sma3002 was 3,3-fold higher than that of the wild-type enzyme. Each of the third generation mutants (15-E4, 18-D7, 20-B9, and 21-D10) showed further improvements in T2$_{(600\ mM)}$, relative to Sma3002. The results suggested that these third generation mutants with higher T2$_{(600\ mM)}$ are more resistant to higher concentrations of 1,3-propanediol. It is expected that these mutants will be very useful for 1,3-propanediol bioproduction.

Example 13

One-Point High Throughput Screening Assay to Measure Total Enzyme Turnover Number in the Presence of High Concentrations of 1,3-Propanediol When 1,3-propanediol concentration is higher than about 300 mM, the inactivation of GDH occurs almost immediately after the reaction is initiated. Under these conditions, one cannot use the high throughput screening assay described in Examples 4 and 5 to screen mutants because T1 cannot be accurately measured. The total enzyme turnover number in the presence of high concentrations of 1,3-propanediol is one of the key enzyme kinetic parameters that is desirable to improve herein. This total enzyme turnover number can be improved by either decreasing the rate of inactivation or increasing the $k_{cat}$. In order to screen for mutants having improved total enzyme turnover number in the presence of high concentrations of 1,3-propanediol, a modified high throughput screening assay was been developed.

Briefly, mutant cells were grown and permeabilized in 96-well plates, as described in EXAMPLE 5. Aliquots (8 µL) of permeabilized cells were transferred into 96-well reaction plates using a Biomek 2000 robot (Beckman-Coulter, Fullerton, Calif.). Reaction at room temperature was initiated by addition to the cells of 40 µL of substrate containing 24 µM coenzyme B$_{12}$, 12 mM glycerol, and 720 mM 1,3-propanediol in 0.1 M potassium-HEPES buffer, pH 8, using Qfill2 (Genetix, New Milton, Hampshire, UK). After incubating the plate at room temperature for approximately 70 min, a 12.5 µL aliquot of the reaction was transferred into a second plate whose wells contained 12.5 µL of 3-methyl-2-benzothiazolinone (MBTH) in 0.4 M glycine-HCl, pH 2.7, using a Biomek 2000 robot (Beckman-Coulter). The 70 min reaction time allows accurate measurement of the total turnover number. The concentration of the product, 3-HP, was determined as described in EXAMPLE 5. The total enzyme turnover number (T(600)) was estimated by measuring the absorbance at 670 nm using a Spectramax 160 plate reader (Molecular Devices, Sunnyvale, Calif.).

This one-point calorimetric assay is simple to execute, since Qfill2 can add substrate to one 96-well plate within 15 sec. Further, the assay can provide higher throughput capability relative to the assay described in EXAMPLES 4 and 5. Comparative results of assays performed in EXAMPLE 5 and in the present example are shown in Table 20 for wild-type GDH and for several mutants having different enzyme kinetic parameters.

TABLE 20

Comparison of T2/T1 and T(600) Values

| Sample | T1 | T2 | T2/T1 | T(600) |
|---|---|---|---|---|
| Background | 0.2 | 0.2 | 1 | 0.82 |
| WT | 0.25 | 1.00 | 4 | 0.10 |
| 1 | 0.37 | 2.08 | 5.6 | 0.46 |
| 2 | 0.19 | 1.76 | 9.3 | 0.41 |
| 3 | 0.09 | 0.98 | 11.9 | 0.11 |
| 4 | 0.51 | 1.72 | 3.4 | 0.23 |

These results demonstrated that each assay screens for different kinetic parameters. Those mutants identified by the screening assay described in the present Example are more resistant to the higher concentrations of 1,3-propanediol and generally have improved stability and reasonable values for $k_{cat}$.

Example 14

Correlation Between Enzyme Structure and Mutations

In this Example, the position of mutations having an increased T2 or increased T2/T1 ratio relative to the wild-type GDH are examined, with respect to the 3-dimensional crystal structure of GDH. This permitted the identification of regions within the dehydratase that could be considered mutational "hot spots", where the mutations frequently lead to improved reaction kinetics (such that the rate of inactivation was reduced). Alternative sequence modifications in these regions would likely result in additional mutants having improvements in reaction kinetics.

Position of Mutations Correlated to 3-Dimensional Structure

Figure 3:
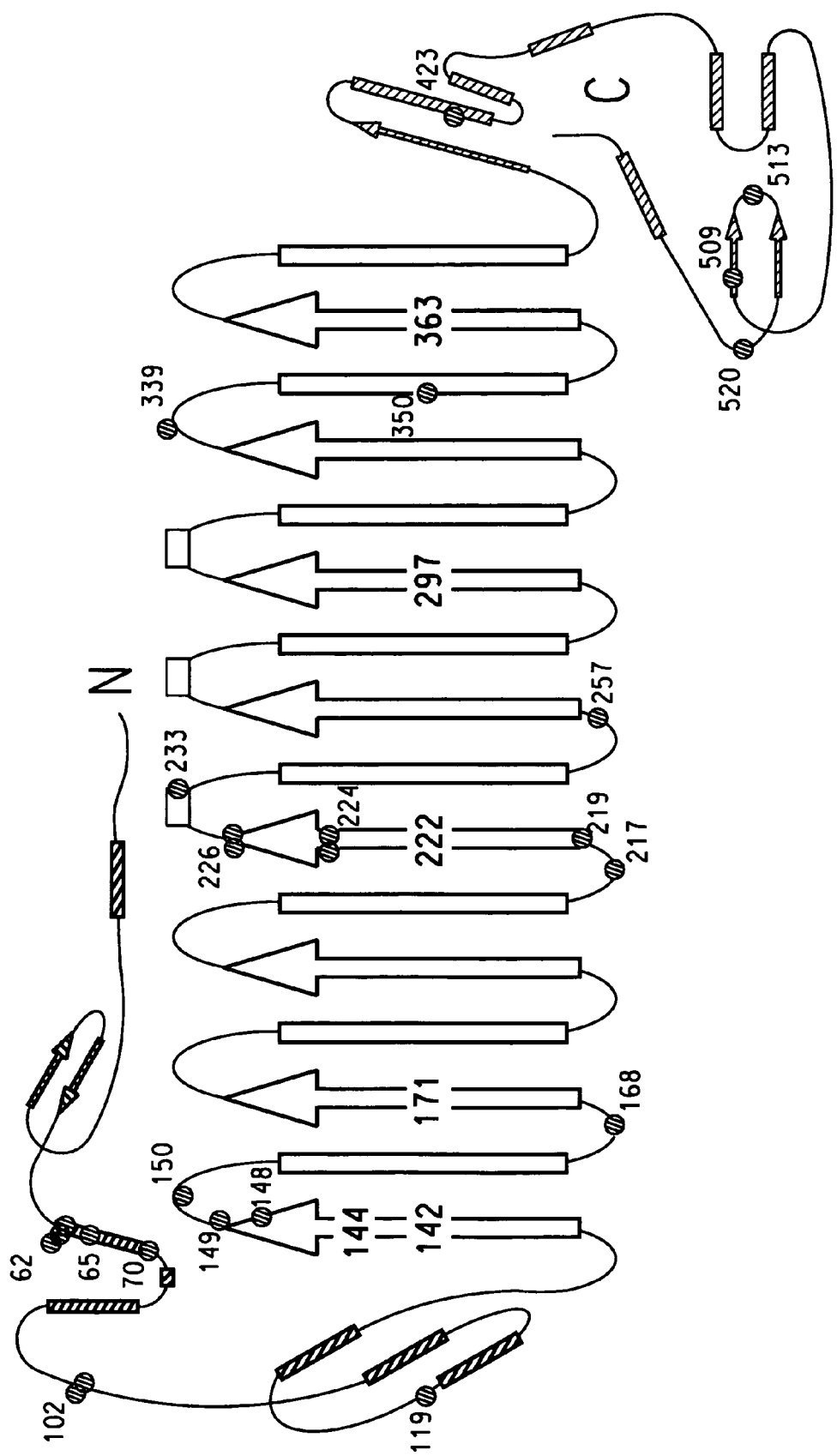
FIG. 3 shows the distribution of mutants containing a single-point mutation (relative to wild-type GDH) on the α-subunit.
Figure 4:
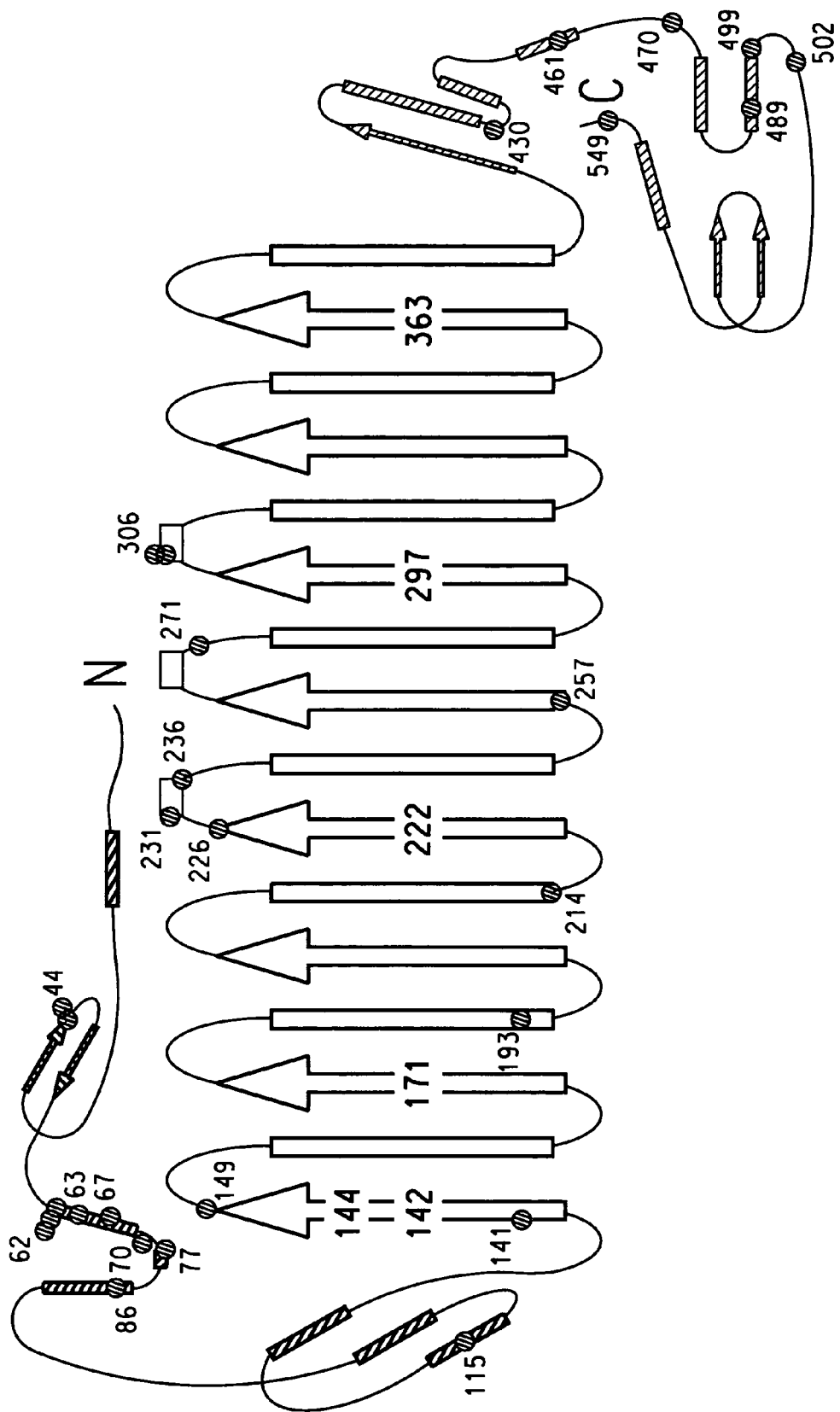
FIG. 4 shows the distribution of mutants containing multiple-point mutations (relative to wild-type GDH) on the α-subunit.

The three-dimensional crystal structure of substrate-free form dehydratase has been determined by X-ray crystallography (Liao et al., *J. Inorganic Biochem.* 93(1-2): 84-91 (2003)); additionally, the structure of the enzyme in complex with 1,2-propanediol has also been reported (Yamanishi et al., *Eur. J. Biochem.* 269:4484-4494 (2002)). Based on these structures, mutations that led to an improvement in either the T2/T1 ratio or T2 (from Examples 6-12 were mapped onto a schematic diagram of each GDH subunit. More specifically, FIG. 3 shows the distribution of mutants containing a single-point mutation (relative to wild-type GDH) on the α-subunit (representing 88% of all single-point mutations). In contrast, FIG. 4 shows the distribution of mutants containing multiple-point mutations (relative to wild-type GDH) on the α-subunit; this subunit contained 58% of the total multiple-point mutations, with the remaining mutations distributed between the β- (31%) and γ- (11%) subunits, respectively.

Hot spots Identified from the Positive Hits

Although mutations within both the single-point and multiple-point mutants are located in all three subunits of GDH and are distributed throughout the large α-subunit, those mutants containing single-point mutations and those mutants containing multiple-point mutations displayed two common hot spots within the α-subunit.

One mutation hotspot is located on the second α helix (residues 62-70) from the N-terminal of the α-subunit. There are five single-point mutants found in this region: 3 of them have mutations at residue 62 with different amino acid substitutions, 1 has a mutation at residue 65, and 1 has a mutation at residue 70 (FIG. 3). Six mutation sites from the multiple-point mutants are also located on this helix: 3 are at residue 62 and 1 each at residues 63, 67 and 70, respectively (FIG. 4).

The second hot spot is the region that includes a portion of the 4th β-strand of the TIM barrel and the following loop and a short helix (residues 224-236) of the α-subunit. This hot spot is in the vicinity of the active site. There are five single-site mutations found in this region. Residue 224 possessed different amino acid substitutions in two mutants. Residue 226 is the mutation site of two identical mutants. One mutant is on residue 233. Additionally, three mutation sites of the multiple-site mutants are located in this region (residues 226, 231, and 236).

Example 15

Site-Saturation Mutagenesis of GDH Mutants

Three mutation sites present in the mutants characterized in Example 9 were subjected to site-saturation mutagenesis. Specifically, these sites were: γ-Thr53 (found in mutant Xba3009), α-Leu509 (found in mutant Xba3029) and α-Val224 (found in mutant 4BR1001). To prepare the saturation mutagenesis libraries, the 1-E1 and 8-C9 mutants (Examples 9 and 10, respectively) were purified from their host cells and used as templates, along with the degenerate primers shown below in Table 21.

TABLE 21

Saturation Mutagenesis libraries

| Library Name | Saturation Mutagenesis Site(s) | Template | Degenerate Primer |
|---|---|---|---|
| GDH-SM1 | γ-T53 | 1-E1 | T53-SM-for: 5'-tg cgg atc tcc cgc cag NNN ctt gag tac cag g-3' (SEQ ID NO:340) |
| GDH-SM2 | α-L509 | 1-E1 | L509-SM-for: 5'-ctg cag acc tcg gcc att NNN gat cgg cag ttc gag gtg-3' (SEQ ID NO:341) |
| GDH-SM3 | α-V224 | 8-C9 | V224-SM-for: 5'-agc tac gcc gag acg NNN tcg gtc tac ggc acc-3' (SEQ ID NO:342) |
| GDH-SM4 | α-L509 and γ-T53 | 1-E1 | L509-SM-for:(SEQ ID NO:341); and T53-SM-for:(SEQ ID NO:340) |

Mutagenesis experiments were carried out using the Stratagene QuikChange Multi Site Directed Mutagenesis Kit (Stratagene, La Jolla, Calif.) according to the manufacturers' instructions, to prepare the GDH-SM1, GDH-SM2, GDH-SM3, and GDH-SM4 libraries. Following electroporation of the plasmids into *E. coli* strain 5K(DE3) (as described in Example 1), 88 mutant colonies from each library were screened using the one-point GDH assay to estimate total enzyme turnover number in the presence of high concentrations of 1,3-propanediol. The best hit from each screen was then subjected to DNA sequence analysis. The following Table shows the results. The SEQ ID NO: of the DNA sequence of the enzyme is provided in the first column of the Table.

TABLE 22

T(600) Values and Mutations in Four Saturation Mutants

| Mutant | Origin of Mutant | Mutation | T(600)* |
|---|---|---|---|
| WT (SEQ ID NO:1) | — | — | 1 |
| Sma3002 (SEQ ID NO:140) | Example 6 | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) | 3.3 |
| Xba3007 (SEQ ID NO:40) | Example 6 | ACC(γ-Thr53) to GCC(Ala) | 0.7 |
| Xba3029 (SEQ ID NO:44) | Example 6 | CTC(α-Leu509) to TTC(Phe) | 1.4 |
| 4BR1001 (SEQ ID NO:171) | Example 6 | GGC(α-Gly216) to GGG(Gly); GTG(α-Val224) to TTG(Leu) | 2.4 |
| 8-C9 (SEQ ID NO:212) | Example 10 | TAC(α-Tyr502) to CAC(His); TAA(stop of α) to CAA(Gln); CAA(β-Gln2) to CGA(Arg); TTT(β-Phe11) to TTC(Phe) | 3.1 |

TABLE 22-continued

T(600) Values and Mutations in Four Saturation Mutants

| Mutant | Origin of Mutant | Mutation | T(600)* |
|---|---|---|---|
| 1-E1 (SEQ ID NO:198) | Example 9 | TAA(stop of α) to CAA(Gln) | 2.2 |
| GDH-SM1-G11 (SEQ ID NO:301) | Present Example | TAA(stop of α) to CAA(Gln); ACC(γ-Thr53) to TCC(Ser) | 4.3 |
| GDH-SM2-B11 (SEQ ID NO:304) | Present Example | TAA(st p of α) t CAA(Gln); CTC(α-Leu509) t TTT(Phe) | 4.1 |
| GDH-SM3-D2 (SEQ ID NO:307) | Present Example | GTG(α-Val224) to TTG(Leu); TAC(α-Tyr502) to CAC(His); TAA(stop of α) to CAA(Gln); CAA(β-Gln2) to CGA(Arg); TTT(β-Phe11) to TTC(Phe) | 4.0 |
| GDH-SM4-H2 (SEQ ID NO:310) | Present Example | TAA(stop of α) to CAA(Gln); ACC(γ-Thr53) to TGT(Cys) | 4.1 |

*The T(600) values are relative numbers, normalized to the wild-type. Those mutants shown in bold text are saturation mutants.

All four saturation mutants (GDH-SM1-G11, GSH-SM2-B11, GDH-SM3-D2, and GDH-SM4-H2 [shown in bold text]) showed further improvements in T(600), as compared to the parent mutant genes from which they were derived. Interestingly, in mutant GDH-SM4-H2 a three-base change was identified (i.e., ACC(γ-Thr53) to TGT(Cys)). This type of mutation is extremely difficult to generate using error-prone PCR.

Example 16

The Recombinogenic Extension Method Using Unpaired Primers to Generate GDH Mutants Despite significant improvements in the GDH rate of inactivation in the presence of glycerol and 1,3-propanediol using random mutagenesis, rational design mutagenesis, and saturation mutagenesis (Examples 6, 8-11, and 15), further improvements were desirable for industrial applications. Thus, 24 glycerol dehydratase mutants from Examples 6, 9, 10, and 15 were utilized as parent templates in a single recombinogenic extension reaction using the unpaired primers method (U.S. 60/360,279).

Attaching a Short Flanking DNA Fragment to the 5' or 3' End of Parent Genes

A short flanking DNA fragment was attached to the 5' or 3' end of the parent genes by PCR, which was subsequently used as the binding sites for the recombinogenic extension method using unpaired primers. Plasmids containing GDHs were purified from host cells and used as templates.

Specifically, forward primer GDHM-F1 (SEQ ID NO: 343) and reverse primer GDHM-R1 (SEQ ID NO: 344) were used to amplify the following template genes in standard high fidelity PCR reactions using the Expand High Fidelity PCR System (Roche Applied Science, Indianapolis, Ind.): 1-E1 (SEQ ID NO:198), wild type GDH (SEQ ID NO:1), Xba3023 (SEQ ID NO:182), Xba3010 (SEQ ID NO:175), 8-C9 (SEQ ID NO:212), 4BR1001 (SEQ ID NO:171), Xba3015 (SEQ ID NO:147), Xba3008 (SEQ ID NO:151), Sma3003 (SEQ ID NO:143), Xba3016 (SEQ ID NO:155) and Xba3020 (SEQ ID NO:159). The resulting PCR products were then mixed together in an equal molar ratio, and designated as "mixture-1".

Forward primer GDHM-F2 (SEQ ID NO:345) and reverse primer GDHM-R2 (SEQ ID NO:346) were used to amplify the following genes in a similar manner: Xba3007 (SEQ ID NO:40), Xba3029 (SEQ ID NO:44), Xba3025 (SEQ ID NO:52), Sma3009 (SEQ ID NO:179), Sma3010 (SEQ ID NO:175), Sma3008 (SEQ ID NO:151), RsrII001 (SEQ ID NO:136), PpuMI002 (SEQ ID NO:.128), KG005 (SEQ ID NO:253), GDH-SM1-G11 (SEQ ID NO:301), GDH-SM2-B11 (SEQ ID NO:304), GDH-SM3-D2 (SEQ ID NO:307) and GDH-SM4-H2 (SEQ ID NO:310). The resulting PCR products were then mixed together in an equal molar ratio, and designated as "mixture-2".

The amplified products were purified from agarose gels using a Qiagen DNA extraction kit (Qiagen, Valencia, Calif.), and then used as the parent templates for the recombinogenic extension method with unpaired primers.

Making Recombinogenic Mutant Products Using the Unpaired Primers Method

Recombinogenic products (i.e., GDH mutant genes) were made from the above-mentioned 24 parent templates using two primers: PADH316F1 (SEQ ID NO:29) and T7T (SEQ ID NO:30). PADH316F1 anneals with the 5' end of those templates in "mixture-1" (i.e., 1-E1, wild type GDH, Xba3023, Xba3010, 8-C9, 4BR1001, Xba3015, Xba3008, Sma3003, Xba3016 and Xba3020), due to the addition of the short 5' DNA fragment produced by SEQ ID NO: 343. However, primer PADH316F1 does not bind to the 5' end of the "mixture-2" templates. In like manner, primer T7T anneals to the 3' end of the "mixture-2" templates (i.e., Xba3007, Xba3029, Xba3025, Sma3009, Sma3010, Sma3008, RsrII001, PpuMI002, KG005, GDH-SM1-G11, GDH-SM2-B11, GDH-SM3-D2 and GDH-SM4-H2), but does not bind to the 3' end of the "mixture-1" templates.

The following reaction mixture was assembled for the reaction: 10 ng "mixture-1", 10 ng "mixture-2", 200 µM each dNTP, 1×PCR Buffer (with 1.5 mM $MgCl_2$, as the final concentration), 286 nM pADH316F1, 286 nM T7T, 0.625 U HotStarTaq (Qiagen, Valencia, Calif.), and $dH_2O$ to 25 µl. Thermal cycling conditions were: 95° C. denaturation for 2 min; followed by 60 cycles of 30 sec at 95° C., 1 sec+1 sec per cycle at a gradient between 63-69° C.; 72° C. final extension for 7 min; and hold at 4° C. An Eppendorf Mastercycler gradient5331 (Eppendorf Scientific, Inc., Westbury, N.Y.) was used for the thermal cycling reactions.

Since the two primers used in the reaction do not match the 5' and 3' ends of any template simultaneously, none of the parent templates can be amplified during the reaction. However, any recombinant DNA product possessing both the 5' and 3' ends would be amplified during subsequent thermal cycles. Following the unpaired primer reaction, the reaction mixtures were loaded onto an agarose gel. At about 66-67° C., a large amount of 2.7 kB PCR products were obtained from the unpaired primer reaction. Products of this size were expected since the original parent molecules used as templates were themselves about 2.7 kB.

Making and Screening the Recombinogenic GDH Mutant Library

The recombinant GDH DNA products (approximately 2.7 kB) were purified from the gel using a Qiagen DNA extraction kit, digested with Xba I and Hind III, and then ligated into the XbaI-Hind/III-digested pGD20 vector (Example 1). The mutant library was obtained by transformation of the ligation mixture into E. coli strain 5K(DE3) by electroporation, as described in Example 1. The library size was over 0.3 million colonies per ligation reaction.

Between 6,000-7,000 mutant colonies were picked from agarose plates and screened using the one-point high throughput screening assay, as described in Example 13. Following primary screening, putative hits were confirmed by a follow-up confirmation assay. Briefly, each putative hit was re-assayed in 8 wells. Results from each individual clone were analyzed statistically to obtain the mean and standard deviation for T(600). These results were compared to the wild-type GDH enzyme.

Additionally, several hits were further investigated using the two-point assay (Example 5) to roughly estimate the change of initial reaction rate and inactivation for these hits.

Table 23 summarizes the results of these various assays for several recombinogenic GDH mutants.

TABLE 23

Characterization of Recombinogenic GDH Mutants Obtained in the Recombinogenic Extension Method using Unpaired Priers

| Mutant | T(600)* | T1* | T2* | T2/T1 ratio* |
|---|---|---|---|---|
| WT | 1.0 | 1.00 | 1.00 | 1.00 |
| SHGDH37 | 6.6 | 0.51 | 2.79 | 5.47 |
| SHGDH51 | 6.2 | 0.19 | 2.63 | 13.84 |
| SHGDH12 | 5.9 | 0.64 | 3.46 | 5.41 |
| SHGDH22 | 5.8 | 0.50 | 3.42 | 6.84 |
| SHGDH38 | 5.7 | — | — | — |
| SHGDH24 | 5.6 | 1.05 | 2.29 | 2.18 |
| SHGDH43 | 5.6 | 0.22 | 2.11 | 9.59 |
| SHGDH25 | 5.1 | — | — | — |
| SHGDH29 | 4.6 | 0.49 | 2.14 | 4.37 |

*The T(600), T1, T2, and the T2/T1 ratio values are relative numbers, normalized to the wild-type. Those mutants shown in bold text were created using the recombinogenic extension method using unpaired primers.

Although different recombinant GDH mutants displayed different enzyme kinetics (despite having similar T(600) values), this merely reflects differences in the parameters that each assay measures. For example, mutants SHGDH24 and SHGDH43 possessed identical T(600) values, but SHGDH24 had only a slightly improved T1 value compared with wild type while SHGDH43 had a largely reduced T1. In the case of SHGDH24, the $k_{cat}$ of the enzyme was not decreased; in contrast, SHGDH43 had a $k_{cat}$ that was greatly reduced. In either case, the GDH enzyme stability of both SHGDH24 and SHGDH43 was increased, thus enabling improvement in the total enzyme turnover number.

SHGDH51 showed the greatest improvement for stability among these mutants, but this mutant did not have the highest total enzyme turnover number because its $k_{cat}$ was largely decreased. SHGDH37 displayed the greatest improvement for T(600) among these mutants, but its T2 value is less than that of SHGDH12, indicating that SHGDH37 is more resistant to high concentrations of 1,3-propanediol than SHGDH12.

In any case, however, the results clearly demonstrated substantial improvement in GDH stability, due to the creation of new mutants using the unpaired primer method. Specifically, the best mutant obtained via random mutagenesis had a T(600) of 3.3 (i.e., mutant Sma3002; SEQ ID NO:140); rational combination of mutants identified through random mutagenesis and screening or semi-random combination of these mutations using site-saturation mutagenesis yielded a mutant with a maximum T(600) of 4.3 (i.e., mutant GDH-SM1-G11; SEQ ID NO:301). Thus, it is concluded that the random recombination approach using the recombinogenic extension method using unpaired primers is a more powerful technique than previous rational and semi-random approaches.

Sequence Analysis of the Mutant Genes

Plasmid DNA was purified from the recombinant GDH mutants listed in Table 23 and the entire GDH gene in each was sequenced. Analysis of the mutants, followed by comparison to the original wild type GDH gene sequence, indicated that these recombinant mutant genes contained the single base substitution mutations (point mutations) that appear in Table 24. The SEQ ID NO: of the DNA sequence of the enzyme is provided in the first column of the Table.:

TABLE 24

DNA sequence analysis of Recombinogenic GDH Mutants

| Strain | Mutations |
|---|---|
| SHGDH12 (SEQ ID NO:319) | GTT(α-Val74) to ATT(Ile); GTG(α-Val224) to TTG(Leu); CGC(α-Arg425) to CGT(Arg); TAC(α-Tyr502) to CAC(His); TAA(stop of α) to CAA(Gln); CAA(β-Gln2) to CGA(Arg); TTT(β-Phe11) to TTC(Phe); AAA(β-Lys14) to AGA(Arg) |
| SHGDH22 (SEQ ID NO:322) | GGC(α-Gly216) to GGG(Gly); GTG(α-Val224) to TTG(Leu); CAG(α-Gln337) to CAA(Gln); CGC(α-Arg533) to GGC(Gly); ACC(α-Thr553) to ACG(Thr); TAA(stop of α) to CAA(Gln); ATC(γ-Ile21) to ACC(Thr); CTG(γ-Leu137) to CTA(Leu) |
| SHGDH24 (SEQ ID NO:328) | CGT(α-Arg134) to CGC(Arg); GGC(α-Gly216) to GGG(Gly); GTG(α-Val224) to TTG(Leu); AGC(α-Ser481) to AGT(Ser); ACC(α-Thr553) to ACG(Thr); TAA(stop of α) to CAA(Gln) |
| SHGDH25 (SEQ ID NO:334) | ATG(α-Met62) to CTG(Leu); GTG(α-Val124) to GCG(Ala); GGC(α-Gly216) to GGG(Gly); GTG(α-Val224) to TTG(Leu); TAA(stop of α) to CAA(Gln) |
| SHGDH29 (SEQ ID NO:337) | GCC(α-Ala376) to GCT(Ala); CTC(α-Leu509) to TTT(Phe); ACC(α-Thr553) to ACG(Thr); TAA(stop of α) to CAA(Gln); CAG(γ-Gln101) to CGG(Arg) |
| SHGDH37 (SEQ ID NO:313) | GTG(α-Val224) to TTG(Leu); TAC(α-Tyr502) to CAC(His); TAA(stop of α) to CAA(Gln); CAA(β-Gln2) to CGA(Arg); TTT(β-Phe11) to TTC(Phe); GAG(γ-Glu35) to AAG(Lys) |
| SHGDH38 (SEQ ID NO:325) | GTG(α-Val224) to TTG(Leu); TAC(α-Tyr502) to CAC(His); TAA(stop of α) to CAA(Gln); CAA(β-Gln2) to CGA(Arg); TTT(β-Phe11) to TTC(Phe); GGG(β-Gly19) to GAG(Glu); GAA(β-Glu64) to GAG(Glu); CTT(β-Leu67) to CTC(Leu); AAT(γ-Asn72) to AGT(Ser) |
| SHGDH43 (SEQ ID NO:331) | GGC(α-Gly216) to GGG(Gly); GTG(α-Val224) to TTG(Leu); GAG(α-Glu240) to GAA(Glu); GTG(α-Val301) to GTA(Val); ACC(α-Thr553) to ACG(Thr); TAA(stop of α) to CAA(Gln); AAA(β-Lys166) to AGA(Arg); AAA(β-Lys173) to GAA(Glu); ACC(γ-Thr53) to TCC(Ser) |
| SHGDH51 (SEQ ID NO:316) | TTC(α-Phe339) to GTC(Val); CGC(α-Arg346) to CGG(Arg); ACC(α-Thr553) to ACG(Thr); TAA(stop of α) to CAA(Gln); CCC(β-Pro184) to CCT(Pro); ACC(γ-Thr53) to GCC(Ala) |

Interestingly, all of the mutants (SEQ ID NOs:313, 316, 319, 322, 325, 328, 331, 334, 337) contained an α-β fusion mutation (as originally discovered in the Sma3002 and Xba3009 mutants [Example 6]), indicating that this mutation is very important for T(600) value improvement. SHGDH43 contained mutations from four different parent genes (i.e., 4BR1001, 1-E1, Xba3008 and GDH-SM1-G11), in addition to four newly created mutations. This indicated that at least four crossovers occurred among the four different parent genes during the recombinogenic PCR. SHGDH25 and SHGDH51 contained mutations from three parent genes (i.e., Sma3003, 4BR1001 and 1-E1 for SHGDH25; RsrII001, 1-E1 and Xba3007 for SHGDH51), in addition to several newly created mutations.

SEQUENCE LISTING (346 sequences)

SEQ ID NO: 1 - DNA, 12145 bp, Klebsiella pneumoniae
  CDS (7044)..(8711): DhaB1
  CDS (8724)..(9308): DhaB2
  CDS (9311)..(9736): DhaB3
  ref <302>: TITLE: Improved Process for the Biological Production of 1,3-Propanediol with High Titer
  ref <310>: PATENT DOCUMENT NUMBER: WO 2001012833 A2
  ref <311>: PATENT FILING DATE: 2000-08-18
  ref <312>: PUBLICATION DATE: 2001-02-22
  ref <313>: RELEVANT RESIDUES: (1)..(12145)
gtcgaccaccacggtggtgactttaatgccgctctcatgcagcagctcggtggcggtctcaaaattcaggatgtcgccggtatagtttttgataatcagcaagacgccttcgccgccgtcaatttgcatcgcgcattcaaacattttgtccggcgtcggcgaggtgaatatttcccccggacaggcgccggagagcatgccctggccgatatagccgcagtgcatcggttcatgtccgctgccgccgccggagagcagggccaccttgccagccaccggcgcgtcggtgcgggtcacatacagcgggtcctgatgcagggtcagctgcggatgggctttagccagcccctgtaattgttcattcagtacatcttcaacacggttaatcagctttttcattattcagtgctccgttggagaaggttcgatgccgcctctctgctggcggaggcggtcatcgcgtaggggtatcgtctgacggtggagcgtgcctggcgatatgatgattctggctgagcggacgaaaaaaagaatgccccgacgatcgggtttcattacgaaacattgcttcctgattttgtttctttatggaacgtttttgctgaggatatggtgaaaatgcgagctggcgcgctttttttcttctgccataagcggcggtcaggatagccggcgaagcgggtgggaaaaaattttttgctgattttctgccgactgcgggagaaaaggcggtcaaacacggaggattgtaagggcattatgcggcaaaggagcggatcgggatcgcaatcctgacagagactagggttttttgttccaatatggaacgtaaaaaattaacctgtgtttcatatcagaacaaaaaggcgaaagatttttttgttccctgccggccctacagtgatcgcactgctccggtacgctccgttcaggccgcgcttcactggccggcgcggataacgccagggctcatcatgtctacatgcgcacttatttgagggtgaaaggaatgctaaaagttattcaatctccagccaaatatcttcagggtcctgatgctgctgttctgttcggtcaatatgccaaaaacctggcggagagcttcttcgtcatcgctgacgatttcgtaatgaagctggcgggagagaaagtggtgaatggcctgcagagccacgatattcgctgccatgcggaacggtttaacggcgaatgcagccatgcggaaatcaaccgtctgatggcgattttgcaaaaacagggctgccgcggcgtggtcgggatcggcggtggtaaaaccctcgataccgcgaaggcgatcggttactaccagaagctgccggtggtggtgatcccgaccatcgcctcgaccgatgcgccaaccagcgcgctgtcggtgatctacaccgaagcgggcgagtttgaagagtatctgatctatccgaaaaacccggatatggtggtgatggacacggcgattatcgccaaagcgccggtacgcctgctggtctccggcatgggcgatgcgctctccacctggttcgaggccaaagcttgctacgatgcgcgcgccaccagcatggccggaggacagtccaccgaggcggcgctgagcctcgcccgcctgtgctatgatacgctgctggcggagggcgaaaaggcccgtctggcggcgcaggccggggtagtgaccgaagcgctggagcgcatcatcgaggcgaacacttacctcagcggcattggctttgaaagcagtggcctggccgctgcccatgcaatccacaacggtttcaccattcttgaagagtgccatcacctgtatcacggtgagaaagtggccttcggtaccctggcgcagctggtgctgcagaacagcccgatggacgagattgaaacggtgcagggcttctgccagcgcgtcggcctgccggtgacgctcgcgcagatgggcgtcaaagaggggatcgacgagaaaatcgccgcggtggcgaaagctacctgcgcggaaggggaaaccatccataatatgccgtttgcggtgaccccggagagcgtccatgccgctatcctcaccgccgatctgttaggccagcagtggctggcgcgttaattcgcggtggctaaaccgctggcccaggtcagcggtttttctttctcccctccggcagtcgctgccggaggggttctctatggtacaacgcggaaaaggatatgactgttcagactcaggataccgggaaggcggtctcttccgtcattgcccagtcatggcaccgctgcagcaagtttatgcagcgcgaaacctggcaaacgccgcaccaggcccagggcctgaccttcgactccatctgtcggcgtaaaaccgcgctgctcaccatcggccaggcggcgctggaagacgcctgggagtttatggacggccgcccctgcgcgctgtttattcttgatgagtccgcctgcatcctgagccgttgcggcgagccgcaaaccctggcccagctggctgccctgggatttcgcgacggcagctattgtgcggagagcattatcggcacctgcgcgctgtcgctggccgcgatgcagggccagccgatcaacaccgccggcgatcggcattttaagcaggcgctacagccatggagtttttgctcgacgccggtgtttgataaccacgggcggctgttcggctctatctcgctttgctgtctggtcgagcaccagtccagcgccgacctctccctgacgctggccatcgcccgcgaggtgggtaactccctgcttaccgacagcctgctggcggaatccaaccgtcacctcaatcagatgtacggcctgctggagagcatggacgatggggtgatggcgtggaacgaacagggcgtgctgcagtttctcaatgttcaggcggcgagactgctgcatcttgatgctcaggccagccaggggaaaaatatcgccgatctggtgaccctcccggcgctgctgcgccgcgccatcaaacacgcccgcggcctgaatcacgtcgaagtcacctttgaaagtcagcatcagtttgtcgatgcggtgatcaccttaaaaccgattgtcgaggcgcaaggcaacagttttattctgctgctgcatccggtggagcagatgcggcagctgatgaccagccagctcggtaaagtcagccacacctttgagcagatgtctgccgacgatccggaaacccgacgcctgatccactttggccgccaggcggcgcgcggcggcttcccggtgctactgtgcggcgaagagggggtcgggaaagagctgctgagccaggctattcacaatgaaagcgaacgggcgggcggcccctacatctccgtcaactgccagctatatgccgacagcgtgctgggccaggactttatgggcagcgcccctaccgacgatgaaaatggtcgcctgagccgccttgagctggccaacggcggcaccctgtttctggaaaagatcgagtatctggcgccggagctgcagtcggctctgctgcaggtgattaagcagggcgtgctcacccgcctcgacgcccggcgcctgatcccggtggatgtgaaggtgattgccaccaccaccgtcgatctggccaatctggtggaacagaaccgctttagccgccagctgtactatgcgctgcactcctttgagatcgtcatcccgccgctgcgcgcccgacgcaacagtattccgtcgctggtgcataaccggttgaagagcctggagaagcgtttctcttcgcgactgaaagtggacgatgacgcgctggcacagctggtggcctactcgtggccggggaatgattttgagctcaacagcgtcattgagaatatcgccatcagcagcgacaacggccacattcgcctgagtaatctgccggaatatctcttttccgagcggccgggcggggatagcgcgtcatcgctgctgccggccagcctgacttttagcgccatcgaaaaggaagctattattcacgccgcccgggtgaccagcgggcgggtgcaggagatgtcgcagctgctcaatatcggccgcaccaccctgtggcgcaaaatgaagcagtacgatattgacgccagccagttcaagcgcaagcatcaggcctagtctcttcgattcgcgccatggagaacagggcatccgacaggcgattgctgtagcgtttgagcgcgtcgcgcagcggatgcgcgcggtccatggccgtcagcaggcgttcgagccgacgggactgggtgcgcgccacgtgcagctgggcagaggcgagattcctccccgggatcacgaactgttttaacgggccgctctcggccatattgcggtcgataagccgctccagggcggtgatctcctcttcgccgatcgtctggctcaggcgggtcaggccccgcgcatcgctggccagttcagcccccagcacgaacagcgtctgctgaatatggtgcaggctttcccgcagcccggcgtcgcgggtcgtggcgtagcagacgcccagctgggatatcagttcatcgacggtgccgtaggcctcgacgcgaatatggtctttctcgatgcggctgccgccgtacagggcggtggtgcctttatccccggtgcgggtatagatacgatacattcagtttctctcacttaacggcaggactttaaccagctgcccggcgttggcgccgagcgtacgcagttgatcgtcgctatcggtgacgtgtccggtagccagcggcgcgtccgccggcagctgggcatgagtgagggctatctcgccggacgcgctgagcccgatacccacccgcaggggcgagcttctggccgccagggcgcccagcgcagcggcgtcaccgcctccgtcataggttatggtctggcaggggaccccctgctcctccagcccccagcacagctcattgatggcgccggcatggtgcccgcgcggatcgtaaaacaggcgtacgcctggcggtgaaagcgacatgacggtcccctcgttaacactcagaatgcctggcggaaaatcgcggcaatctcctgctcgttgcctttacgcgggttcgagaacgcattgccgtcttttagagccatctccgccatgtaggggaagtcggcctcttttacccccagatcgcgcagatgctgcggaataccgatatccatcgacagacgcgtgatagcggcgatggctttttccgccgcgtcgagagtggacagtccggtgatattttcgcccatcagttcagcgatatcggcgaatttctccgggttggcgatcaggttgtagcgcgccacatgcggcagcaggacagcgttggccacgccgtgcggcatgtcgtacaggccgcccagctggtgcgccatggcgtgcacgtagccgaggttggcgttattgaaagccatcccggccagcagagaagcataggccatgttttcccgcgcctgcagattgctgccgagggccacggcctggcgcaggttgcgggcgatgaggcggatcgcctgcatggcggcggcgtccgtcaccgggttagcgtctttggagatataggcctctacggcgtgggtcagggcatccatcccggtcgccgcggtcagggcggccggtttaccgatcatcagcagtggatcgttgatagagaccgacggcagtttgcgccagctgacgatcacaaacttcactttggtttcggtgttggtcaggacgcagtggcgggtgacctcgctggcggtgccggcggtggtattgaccgcgacgataggcggcagcgggttggtcagggtctcgattccggcatactggtacagatcgccctcatgggtggcggcgatgccgatgcctttgccgcaatcgtgcgggctgccgccgcccacggtgacgatgatgtcgcactgttcgcggcgaaacacggcgaggccgtcgcgcacgttggtgtctttcgggttcggctcgacgccgtcaaagatcgccacctcgatcccggcctcccgcagataatgcagggttttgtccaccgcgccatctttaattgcccgcaggcctttgtcggtgaccagcagggcttttttcccccccagcagctggcagcgttcgccgactacggaaatggcgttggggccaaaaaagttaacgtttggcaccagataatcaaacatacgatagctcataatataccttctcgcttcaggttataatgcggaaaaacaatccagggcgcactgggctaataattgatcctgctcgaccgtaccgccgctaacgccgacggcgccaattacctgctcattaaaaataactggcaggccgccgccaaaaataataattcgctgttggttggttagctgcagaccgtacagagattgtcctggctggaccgctgacgtaatttcatgggtaccttgcttcaggctgcaggcgctccaggctttattcagggaaatatcgcagctggagacgaaggcctcgtccatccgctggataagcagcgtgttgcctccgcggtcaactacggaaaacaccaccgccacgttgatctcagtggcttttttttccaccgccgccgccatttgctgggcggcggccagggtgattgtctgaacttgttggctcttgttcatcattctctcccgcaccaggataacgctggcgcgaatagtcagtagggggcgatagtaaaaaactattaccattcggttggcttgctttatttttgtcagcgttattttgtcgcccgccatgatttagtcaatagggttaaaatagcgtcggaaaaacgtaattaagggcgttttttattaattgatttatatcattgcgggcgatcacattttttatttttgccgccggagtaaagtttcatagtgaaactgtcggtagatttcgtgtgccaaattgaaacgaaattaaatttatttttttcaccactggctcatttaaagttccgctattgccggtaatggccgggcggcaacgacgctggcccggcgtattcgctaccgtctgcggatttcaccttttgagccgatgaacaatgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaagcggaggtcagcatgccgttaatagccgggattgatatcggcaacgccaccaccgaggtggcgctggcgtccgactacccgcaggcgagggcgtttgttgccagcgggatcgtcgcgacgacgggcatgaaagggacgcgggacaatatcgccgggaccctcgccgcgctggagcaggccctggcgaaaacaccgtggtcgatgagcgatgtctctcgcatctatcttaacgaagccgcgccggtgattggcgatgtggcgatggagaccatcaccgagaccattatcaccgaatcgaccatgatcggtcataacccgcagacgccgggcggggtgggcgttggcgtggggacgactatcgccctcgggcggctggcgacgctgccggcggcgcagtatgccgaggggtggatcgtactgattgacgacgccgtcgatttccttgacgccgtgtggtggctcaatgaggcgctcgaccgggggatcaacgtggtggcggcgatcctcaaaaaggacgacggcgtgctggtgaacaaccgcctgcgtaaaaccctgccggtggtggatgaagtgacgctgctggagcaggtccccgagggggtaatggcggcggtggaagtggccgcgccgggccaggtggtgcggatcctgtcgaatccctacgggatcgccaccttcttcgggctaagcccggaagagacccaggccatcgtccccatcgcccgcgccctgattggcaaccgttccgcggtggtgctcaagaccccgcagggggatgtgcagtcgcgggtgatcccggcgggcaacctctacattagcggcgaaaagcgccgcggagaggccgatgtcgccgagggcgcggaagccatcatgcaggcgatgagcgcctgcgctccggtacgcgacatccgcggcgaaccgggcacccacgccggcggcatgcttgagcgggtgcgcaaggtaatggcgtccctgaccggccatgagatgagcgcgatatacatccaggatctgctggcggtggatacgtttattccgcgcaaggtgcagggcgggatggccggcgagtgcgccatggagaatgccgtcgggatggcggcgatggtgaaagcggatcgtctgcaaatgcaggttatcgcccgcgaactgagcgcccgactgcagaccgaggtggtggtgggcggcgtggaggccaacatggccatcgccggggcgttaaccactcccggctgtgcggcgccgctggcgatcctcgacctcggcgccggctcgacggatgcggcgatcgtcaacgcggaggggcagataacggcggtccatctcgccggggcggggaatatggtcagcctgttgattaaaaccgagctgggcctcgaggatctttcgctggcggaagcgataaaaaaatacccgctggccaaagtggaaagcctgttcagtattcgtcacgagaatggcgcggtggagttctttcgggaagccctcagcccggcggtgttcgccaaagtggtgtacatcaaggagggcgaactggtgccgatcgataacgccagcccgctggaaaaaattcgtctcgtgcgccggcaggcgaaagagaaagtgtttgtcaccaactgcctgcgcgcgctgcgccaggtctcacccggcggttccattcgcgatatcgcctttgtggtgctggtgggcggctcatcgctggactttgagatcccgcagcttatcacggaagccttgtcgcactatggcgtggtcgccgggcagggcaatattcggggaacagaagggccgcgcaatgcggtcgccaccgggctgctactggccggtcaggcgaattaaacgggcgctcgcgccagcctctctctttaacgtgctatttcaggatgccgataatgaaccagacttctaccttaaccgggcagtgcgtggccgagtttcttggcaccggattgctcattttcttcggcgcgggctgcgtcgctgcgctgcgggtcgccggggccagctttggtcagtgggagatcagtattatctggggccttggcgtcgccatggccatctacctgacggccggtgtctccggcgcgcacctaaatccggcggtgaccattgccctgtggctgttcgcctgttttgaacgccgcaaggtgctgccgtttattgttgcccagacggccggggccttctgcgccgccgcgctggtgtatgggctctatcgccagctgtttctcgatcttgaacagagtcagcatatcgtgcgcggcactgccgccagtcttaacctggccggggtcttttccacgtacccgcatccacatatcacttttatacaagcgtttgccgtggagaccaccatcacggcaatcctgatggcgatgatcatggccctgaccgacgacggcaacggaattc

SEQ ID NO: 2 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 3 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 4 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 5 - DNA, 24 bp, Artificial Sequence
  Primer DHA-F1
gacggtatcgataagcttaaggag

SEQ ID NO: 6 - DNA, 24 bp, Artificial Sequence
  Primer DHA-R1
ggtggcggccgctctagattagct

SEQ ID NO: 7 - DNA, 24 bp, Artificial Sequence
  Primer DHA-R2
gaatgcgcaccacccgggcgtgaa

SEQ ID NO: 8 - DNA, 33 bp, Artificial Sequence
  Primer pGD20RM-F1
gaagatgcgtgcccgcaggaccccctccaacca

SEQ ID NO: 9 - DNA, 33 bp, Artificial Sequence
  Primer pGD20RM-R1
tggttggagggggtcctgcgggcacgcatcttc

SEQ ID NO: 10 - DNA, 36 bp, Artificial Sequence
  Primer TB4BF
gagctgggcatgcgtgggttaaccagctacgccgag

SEQ ID NO: 11 - DNA, 36 bp, Artificial Sequence
  Primer TB4BR
ctcggcgtagctggttaacccacgcatgcccagctc

SEQ ID NO: 12 - DNA, 33 bp, Artificial Sequence
  Primer pGD20RM-F2
actcggatattcgccggaccgcgcgcaccctga

SEQ ID NO: 13 - DNA, 33 bp, Artificial Sequence
  Primer pGD20RM-R2
tcagggtgcgcgcggtccggcgaatatccgagt

SEQ ID NO: 14 - DNA, 23 bp, Artificial Sequence
  Primer GD-C
gcggccgctctagattagcttcc

SEQ ID NO: 15 - DNA, 63 bp, Artificial Sequence
  Primer pGD20RM-F3
gcccgcaggaccccctccaaccagtgccacgtcaccaatctcaaagataatccggtgcagatt

SEQ ID NO: 16 - DNA, 61 bp, Artificial Sequence
  Primer TB4B-R1
gcgtgggttaaccagctacgccgagacggtgtcggtctacggcaccgaagcggtatttacc

SEQ ID NO: 17 - DNA, 72 bp, Artificial Sequence
  Primer pGD20RM-R4
ggtgcgcgcggtgcggcgaatatccgagtgggagaaagtctggtcgttggcggacgccacttcgaggtcgag

SEQ ID NO: 18 - protein, 6 aa, Artificial Sequence
  Fusion protein linker in clone Sma3002
QGGIPV

SEQ ID NO: 19 - protein, 6 aa, Artificial Sequence
  Fusion protein linker in clone Xba3009
EGGIPV

SEQ ID NO: 20 - DNA, 28 bp, Artificial Sequence
  Primer 2-F4-F1
ctacgccgagacgctgtcggtctacggc

SEQ ID NO: 21 - DNA, 28 bp, Artificial Sequence
  Primer 2-F4-R1
gccgtagaccgacagcgtctcggcgtag

SEQ ID NO: 22 - DNA, 27 bp, Artificial Sequence
  Primer 12-B1-F1
ggatctcccgccaggcccttgagtacc

SEQ ID NO: 23 - DNA, 27 bp, Artificial Sequence
  Primer 12-B1-R1
ggtactcaagggcctggcgggagatcc

SEQ ID NO: 24 - DNA, 33 bp, Artificial Sequence
  Primer 16-H5-F1
cagacctcggccattttcgatcggcagttcgag

SEQ ID NO: 25 - DNA, 33 bp, Artificial Sequence
  Primer 16-H5-R1
ctcgaactgccgatcgaaaatggccgaggtctg

SEQ ID NO: 26 - DNA, 27 bp, Artificial Sequence
  Primer 1-E1-F1
gacaccattgaacaaggcggtattcct

SEQ ID NO: 27 - DNA, 27 bp, Artificial Sequence
  Primer 1-E1-R1
aggaataccgccttgttcaatggtgtc

SEQ ID NO: 28 - DNA, 33 bp, Artificial Sequence
  Primer 22-G7-F1
cccgacaccattgaagaaggcggtattcctgtg

SEQ ID NO: 29 - DNA, 33 bp, Artificial Sequence
  Primer 22-G7-R1
cacaggaataccgccttcttcaatggtgtcggg

SEQ ID NO: 30 - DNA, 27 bp, Artificial Sequence
  Primer 7A-C1-F1
gcgctgatgggctgttcggagagcaag

SEQ ID NO: 31 - DNA, 27 bp, Artificial Sequence
  Primer 7A-C1-R1
cttgctctccgaacagcccatcagcgc

SEQ ID NO: 32 - DNA, 34 bp, Artificial Sequence
  Primer 7C-A5-F1
ggcggtattcctgtgcgacagacaacccaaattc

SEQ ID NO: 33 - DNA, 34 bp, Artificial Sequence
  Primer 7C-A5-R1
gaatttgggttgtctgtcgcacaggaataccgcc

SEQ ID NO: 34 - DNA, 27 bp, Artificial Sequence
  Primer 8-C9-F1
gcgctgatgggctattcggagagcaag

SEQ ID NO: 35 - DNA, 27 bp, Artificial Sequence
  Primer 8-C9-R1
cttgctctccgaatagcccatcagcgc

SEQ ID NO: 36 - DNA, 27 bp, Artificial Sequence
  Primer 9-D7-F1
gtcaccggcgattacctgcagacctcg

SEQ ID NO: 37 - DNA, 27 bp, Artificial Sequence
  Primer 9-D7-R1
cgaggtctgcaggtaatcgccggtgac

SEQ ID NO: 38 - DNA, 34 bp, Artificial Sequence
  Primer 10-G6-F1
ggcggtattcctgtgcaacagacaacccaaattc

SEQ ID NO: 39 - DNA, 34 bp, Artificial Sequence
  Primer 10-G6-R1
gaatttgggttgtctgttgcacaggaataccgcc

SEQ ID NO: 40 - DNA, 2693 bp, Klebsiella pneumoniae
  CDS (1)..(1668): alpha subunit
  misc_feature (1)..(2693): Xba3007
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 41 - protein, 555 aa, Klebsiella pneumoniae; identical to SEQ ID NO: 2

SEQ ID NO: 42 - protein, 194 aa, Klebsiella pneumoniae; identical to SEQ ID NO: 3

SEQ ID NO: 43 - protein, 141 aa, Klebsiella pneumoniae
MSEKTMRVQDYPLATRCPEHILTPTGKPLTDITLEKVLSGEVGPQDVRISRQALEYQAQIAEQMQRHAVARNFRRAAELIAIPDERILAIYNALRPFRSSQAELLAIADELEHTWHATVNAAFVRESAEVYQQRHKLRKGS

SEQ ID NO: 44 - DNA, 2693 bp, Klebsiella pneumoniae
  CDS (1)..(1668): alpha subunit
  misc_feature (1)..(2693): Xba3029
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattttcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 45 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAIFDRQFEVVSAVNDINDYQGPGTGYRISAERWAEIKNIPGVVQPDTIE

SEQ ID NO: 46 - protein, 194 aa, Klebsiella pneumoniae; identical to SEQ ID NO: 3

SEQ ID NO: 47 - protein, 141 aa, Klebsiella pneumoniae; identical to SEQ ID NO: 4

SEQ ID NO: 48 - DNA, 2693 bp, Klebsiella pneumoniae
  CDS (1)..(1668): alpha subunit
  misc_feature (1)..(2693): xba3004
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcctgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacgctctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgagcgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 49 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGLTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 50 - protein, 194 aa, Klebsiella pneumoniae
VQQTTQIQPSFTLKTREGGVASADERADEVVIGVGPAFDKHQHHALIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVSDQMVRPKFMAKAALFHIKETKHVVQDAEPVTLHIDLVRE

SEQ ID NO: 51 - protein, 141 aa, Klebsiella pneumoniae; identical to SEQ ID NO: 4

SEQ ID NO: 52 - DNA, 2693 bp, Klebsiella pneumoniae
  CDS (1)..(1668): alpha subunit
  misc_feature (1)..(2693): Xba3025
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggacctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 53 - protein, 555 aa, Klebsiella pneumoniae; identical to SEQ ID NO: 2

SEQ ID NO: 54 - protein, 194 aa, Klebsiella pneumoniae; identical to SEQ ID NO: 3

SEQ ID NO: 55 - protein, 141 aa, Klebsiella pneumoniae
MSEKTMRVQDYPLATRCPEHILTPTGKPLTDITLEKVLSGEVGPQDVRTSRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 56 - DNA, 2693 bp, Klebsiella pneumoniae
  CDS (1)..(1668): alpha subunit
  misc_feature (1)..(2693): Xba3038
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtacttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 57 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVLTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 58 - protein, 194 aa, Klebsiella pneumoniae; identical to SEQ ID NO: 3

SEQ ID NO: 59 - protein, 141 aa, Klebsiella pneumoniae; identical to SEQ ID NO: 4

SEQ ID NO: 60 - DNA, 2693 bp, Klebsiella pneumoniae
  CDS (1)..(1668): alpha subunit
  misc_feature (1)..(2693): Xba3030
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaagtgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 61 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKVRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 62 - protein, 194 aa, Klebsiella pneumoniae; identical to SEQ ID NO: 3

SEQ ID NO: 63 - protein, 141 aa, Klebsiella pneumoniae; identical to SEQ ID NO: 4

SEQ ID NO: 64 - DNA, 2693 bp, Klebsiella pneumoniae
  CDS (1)..(1668): alpha subunit
  misc_feature (1)..(2693): Xba3006
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagcggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcgccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 65 - protein, 555 aa, Klebsiella pneumoniae
MKRSKRFAVLAQRPVNQDGLIGEWPEEGLIAMDSPFDPVSSVKADNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNIAGLDIVGALSRSGFEDIASNILNMLRQRVTGDYLQTSAILDRQFEVVSAVNDINDYQGPGTGYRISAERWAEIKNIPGVVQPDTIE

SEQ ID NO: 66 - protein, 194 aa, Klebsiella pneumoniae; identical to SEQ ID NO: 3

SEQ ID NO: 67 - protein, 141 aa, Klebsiella pneumoniae; identical to SEQ ID NO: 4

SEQ ID NO: 68 - DNA, 2693 bp, Klebsiella pneumoniae
  CDS (1)..(1668): alpha subunit
  misc_feature (1)..(2693): Xba3031
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggcctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 69 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSAYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 70 - protein, 194 aa, Klebsiella pneumoniae; identical to SEQ ID NO: 3

SEQ ID NO: 71 - protein, 141 aa, Klebsiella pneumoniae; identical to SEQ ID NO: 4

SEQ ID NO: 72 - DNA, 2693 bp, Klebsiella pneumoniae
  CDS (1)..(1668): alpha subunit
  misc_feature (1)..(2693): Xba3017
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccattactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttcccagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 73 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFPEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 74 - protein, 194 aa, Klebsiella pneumoniae; identical to SEQ ID NO: 3

SEQ ID NO: 75 - protein, 141 aa, Klebsiella pneumoniae; identical to SEQ ID NO: 4

SEQ ID NO: 76 - DNA, 2693 bp, Klebsiella pneumoniae
  CDS (1)..(1668): alpha subunit
  misc_feature (1)..(2693): Xba3005
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttgtcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgaactggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaaggatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 77 - protein, 555 aa, Klebsiella pneumoniae
MKRSKRFAVLAQRPVNQDGLIGEWPEEGLIAMDSPFDPVSSVKVDNGLIVELDGKRRDQFDMIDRFVADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 78 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVKDQMVRPKFMAKAALFHIKETKHVVQDAEPVTLHIDLVRE

SEQ ID NO: 79 - protein, 141 aa, Klebsiella pneumoniae; identical to SEQ ID NO: 4

SEQ ID NO: 80 - DNA, 2693 bp, Klebsiella pneumoniae
  CDS (1)..(1668): alpha subunit
  misc_feature (1)..(2693): Xba3033
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaacgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcagggcgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 81 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKTRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 82 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQGAEPVTLHIDLVRE

SEQ ID NO: 83 - protein, 141 aa, Klebsiella pneumoniae; identical to SEQ ID NO: 4

SEQ ID NO: 84 - DNA, 2693 bp, Klebsiella pneumoniae
  CDS (1)..(1668): alpha subunit
  misc_feature (1)..(2693): Xba3032
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgataacgcgatcaacgttgagcgcacagagcaggcaatgcgcctggaggcggaggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 85 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADNAINVERTEQAMRLEAEEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 86 - protein, 194 aa, Klebsiella pneumoniae; identical to SEQ ID NO: 3

SEQ ID NO: 87 - protein, 141 aa, Klebsiella pneumoniae; identical to SEQ ID NO: 4

SEQ ID NO: 88 - DNA, 2693 bp, Klebsiella pneumoniae
  CDS (1)..(1668): alpha subunit
  misc_feature (1)..(2693): Xba3018
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgataacgcgatcaacgtcgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 89 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADNAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 90 - protein, 194 aa, Klebsiella pneumoniae; identical to SEQ ID NO: 3

SEQ ID NO: 91 - protein, 141 aa, Klebsiella pneumoniae; identical to SEQ ID NO: 4

SEQ ID NO: 92 - DNA, 2693 bp, Klebsiella pneumoniae
  CDS (1)..(1668): alpha subunit
  misc_feature (1)..(2693): Xba3014
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgtcgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgagcgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcagaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 93 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLSPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 94 - protein, 194 aa, Klebsiella pneumoniae; identical to SEQ ID NO: 3

SEQ ID NO: 95 - protein, 141 aa, Klebsiella pneumoniae
MSEKTMRVQDYPLATRCPEHILTPTGRPLTDITLEKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 96 - DNA, 2693 bp, Klebsiella pneumoniae
  CDS (1)..(1668): alpha subunit
  misc_feature (1)..(2693): Xba3024
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagaggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcgggggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 97 - protein, 555 aa, Klebsiella pneumoniae
MKRSKRFAVLAQRPVNQDGLIGEWPEEGLIAMDSPFDPVSSVKEDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAGEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 98 - protein, 194 aa, Klebsiella pneumoniae; identical to SEQ ID NO: 3

SEQ ID NO: 99 - protein, 141 aa, Klebsiella pneumoniae; identical to SEQ ID NO: 4

SEQ ID NO: 100 - DNA, 2693 bp, Klebsiella pneumoniae
  CDS (1)..(1668): alpha subunit
  misc_feature (1)..(2693): Xba3026
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcgccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 101 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARALMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 102 - protein, 194 aa, Klebsiella pneumoniae; identical to SEQ ID NO: 3

SEQ ID NO: 103 - protein, 141 aa, Klebsiella pneumoniae; identical to SEQ ID NO: 4

SEQ ID NO: 104 - DNA, 2693 bp, Klebsiella pneumoniae
  CDS (1)..(1668): alpha subunit
  misc_feature (1)..(2693): Sma3009
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacgtggtcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcagagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 105 - protein, 555 aa, Klebsiella pneumoniae
MKRSKRFAVLAQRPVNQDGLIGEWPEEGLIAMDSPFDPVSSVKVDNGLIVELDGKRRDQFDVVDRFIADYAINVERTEQAMRLEAVEIARMLVDIHVSREEIIAITTAITPAKAVEVMAQMNVVEMMMALQKMRARRTPSNQCHVTNLRDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 106 - protein, 194 aa, Klebsiella pneumoniae; identical to SEQ ID NO: 3

SEQ ID NO: 107 - protein, 141 aa, Klebsiella pneumoniae; identical to SEQ ID NO: 4

SEQ ID NO: 108 - DNA, 2693 bp, Klebsiella pneumoniae
  CDS (1)..(1668): alpha subunit
  misc_feature (1)..(2693): Sma3010
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacgtgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgtgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 109 - protein, 555 aa, Klebsiella pneumoniae
MKRSKRFAVLAQRPVNQDGLIGEWPEEGLIAMDSPFDPVSSVKVDNGLIVELDGKRRDQFDVIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 110 - protein, 194 aa, Klebsiella pneumoniae
VQQTTQIQPSFTLKTREGGVASADERADEVVIGVGPAFDKHQHHTLIDMPHGVILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 111 - protein, 141 aa, Klebsiella pneumoniae; identical to SEQ ID NO: 4

SEQ ID NO: 112 - DNA, 2693 bp, Klebsiella pneumoniae
  CDS (1)..(1668): alpha subunit
  misc_feature (1)..(2693): Sma3014
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccggtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcgttcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctctttaaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 113 - protein, 555 aa, Klebsiella pneumoniae
MKRSKRFAVLAQRPVNQDGLIGEWPEEGLIAMDSPFDPVSSVKVDNGLIVELDGKRRDRFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGVRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 114 - protein, 194 aa, Klebsiella pneumoniae
VQQTTQIQPSLTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 115 - protein, 141 aa, Klebsiella pneumoniae; identical to SEQ ID NO: 4

SEQ ID NO: 116 - DNA, 2693 bp, Klebsiella pneumoniae
  CDS (1)..(1668): alpha subunit
  misc_feature (1)..(2693): Sma3008
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacacgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctaatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 117 - protein, 555 aa, Klebsiella pneumoniae
MKRSKRFAVLAQRPVNQDGLIGEWPEEGLIAMDSPFDPVSSVKVDNGLIVELDGKRRDQFDTIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 118 - protein, 194 aa, Klebsiella pneumoniae; identical to SEQ ID NO: 3

SEQ ID NO: 119 - protein, 141 aa, Klebsiella pneumoniae; identical to SEQ ID NO: 4

SEQ ID NO: 120 - DNA, 2693 bp, Klebsiella pneumoniae
  CDS (1)..(1668): alpha subunit
  misc_feature (1)..(2693): Sma3001
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcagcgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 121 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVSDINDYQGPGTGYRISAERWAEIKNIPGVVQPDTIE

SEQ ID NO: 122 - protein, 194 aa, Klebsiella pneumoniae; identical to SEQ ID NO: 3

SEQ ID NO: 123 - protein, 141 aa, Klebsiella pneumoniae; identical to SEQ ID NO: 4

SEQ ID NO: 124 - DNA, 2693 bp, Klebsiella pneumoniae
  CDS (1)..(1668): alpha subunit
  misc_feature (1)..(2693): PpuMI001
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 125 - protein, 555 aa, Klebsiella pneumoniae; identical to SEQ ID NO: 2

SEQ ID NO: 126 - protein, 194 aa, Klebsiella pneumoniae; identical to SEQ ID NO: 3

SEQ ID NO: 127 - protein, 141 aa, Klebsiella pneumoniae; identical to SEQ ID NO: 4

SEQ ID NO: 128 - DNA, 2693 bp, Klebsiella pneumoniae
  CDS (1)..(1668): alpha subunit
  misc_feature (1)..(2693): PpuMI002
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgcaggaccccctccaaccagtgccacgtcaccaatctcaaacataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 129 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKHNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 130 - protein, 194 aa, Klebsiella pneumoniae; identical to SEQ ID NO: 3

SEQ ID NO: 131 - protein, 141 aa, Klebsiella pneumoniae; identical to SEQ ID NO: 4

SEQ ID NO: 132 - DNA, 2693 bp, Klebsiella pneumoniae
  CDS (1)..(1668): alpha subunit
  misc_feature (1)..(2693): PpuMI005
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgcaggaccccctccaaccaatgccacgtcaccaatctccaagataatcccgtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 133 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLQDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 134 - protein, 194 aa, Klebsiella pneumoniae; identical to SEQ ID NO: 3

SEQ ID NO: 135 - protein, 141 aa, Klebsiella pneumoniae; identical to SEQ ID NO: 4

SEQ ID NO: 136 - DNA, 2693 bp, Klebsiella pneumoniae
  CDS (1)..(1668): alpha subunit
  misc_feature (1)..(2693): RsrII001
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactgtctcccactcggatattcgccggaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 137 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTVSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 138 - protein, 194 aa, Klebsiella pneumoniae; identical to SEQ ID NO: 3

SEQ ID NO: 139 - protein, 141 aa, Klebsiella pneumoniae; identical to SEQ ID NO: 4

SEQ ID NO: 140 - DNA, 2693 bp, Klebsiella pneumoniae
  CDS (1)..(2265): alpha-beta subunit fusion
  misc_feature (1)..(2693): Sma3002
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 141 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 142 - protein, 141 aa, Klebsiella pneumoniae; identical to SEQ ID NO: 4

SEQ ID NO: 143 - DNA, 2693 bp, Klebsiella pneumoniae
  CDS (1)..(1668): alpha subunit
  misc_feature (1)..(2693): Sma3003
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacctgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 144 - protein, 555 aa, Klebsiella pneumoniae
MKRSKRFAVLAQRPVNQDGLIGEWPEEGLIAMDSPFDPVSSVKVDNGLIVELDGKRRDQFDLIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 145 - protein, 194 aa, Klebsiella pneumoniae; identical to SEQ ID NO: 3

SEQ ID NO: 146 - protein, 141 aa, Klebsiella pneumoniae; identical to SEQ ID NO: 4

SEQ ID NO: 147 - DNA, 2693 bp, Klebsiella pneumoniae
  CDS (1)..(1668): alpha subunit
  misc_feature (1)..(2693): Xba3015
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggctcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgccgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgtctttgtccgggagtcggtggaagtgtatcagcagcggcataagctgcgtaaaggaagctaa

SEQ ID NO: 148 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVAQPDTIE

SEQ ID NO: 149 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLPPLSNLELFSQAPLLTLETYRQIGKNAARYARKESPSPVPVVNDQMVRPKFMAKAALFHIKETKHVVQDAEPVTLHIDLVRE

SEQ ID NO: 150 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSQAELLAIADELEHTWHATVNAVFVRESVEVYQQRHKLRKGS

SEQ ID NO: 151 - DNA, 2693 bp, Klebsiella pneumoniae
  CDS (1)..(1668): alpha subunit
  misc_feature (1)..(2693): Xba3008
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccagagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 152 - protein, 555 aa, Klebsiella pneumoniae; identical to SEQ ID NO: 2

SEQ ID NO: 153 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMARAALFHIKETKHVVQDAEPVTLHIDLVRE

SEQ ID NO: 154 - protein, 141 aa, Klebsiella pneumoniae; identical to SEQ ID NO: 4

SEQ ID NO: 155 - DNA, 2693 bp, Klebsiella pneumoniae
  CDS (1)..(1668): alpha subunit
  misc_feature (1)..(2693): Xba3016
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagaccattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 156 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREETIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 157 - protein, 194 aa, Klebsiella pneumoniae; identical to SEQ ID NO: 3

SEQ ID NO: 158 - protein, 141 aa, Klebsiella pneumoniae; identical to SEQ ID NO: 4

SEQ ID NO: 159 - DNA, 2693 bp, Klebsiella pneumoniae
  CDS (1)..(1668): alpha subunit
  misc_feature (1)..(2693): Xba3020
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgacggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 160 - protein, 555 aa, Klebsiella pneumoniae; identical to SEQ ID NO: 2

SEQ ID NO: 161 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVTVVNDQMVRPKFMAKAALFHIKETKHVVQDAEPVTLHIDLVRE

SEQ ID NO: 162 - protein, 141 aa, Klebsiella pneumoniae; identical to SEQ ID NO: 4

SEQ ID NO: 163 - DNA, 2693 bp, Klebsiella pneumoniae
  CDS (1)..(1668): alpha subunit
  misc_feature (1)..(2693): Xba3037
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaagtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcgattttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 164 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAIFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 165 - protein, 194 aa, Klebsiella pneumoniae; identical to SEQ ID NO: 3

SEQ ID NO: 166 - protein, 141 aa, Klebsiella pneumoniae; identical to SEQ ID NO: 4

SEQ ID NO: 167 - DNA, 2693 bp, Klebsiella pneumoniae
  CDS (1)..(1668): alpha subunit
  misc_feature (1)..(2693): Xba3036
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggcctgatcgtcgaactggacggcaaacgccgggaccagtttgacatgatcgaccaatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 168 - protein, 555 aa, Klebsiella pneumoniae
MKRSKRFAVLAQRPVNQDGLIGEWPEEGLIAMDSPFDPVSSVKVDNGLIVELDGKRRDQFDMIDQFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 169 - protein, 194 aa, Klebsiella pneumoniae; identical to SEQ ID NO: 3

SEQ ID NO: 170 - protein, 141 aa, Klebsiella pneumoniae; identical to SEQ ID NO: 4

SEQ ID NO: 171 - DNA, 2693 bp, Klebsiella pneumoniae
  CDS (1)..(1668): alpha subunit
  misc_feature (1)..(2693): 4BR1001
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgctgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 172 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 173 - protein, 194 aa, Klebsiella pneumoniae; identical to SEQ ID NO: 3

SEQ ID NO: 174 - protein, 141 aa, Klebsiella pneumoniae; identical to SEQ ID NO: 4

SEQ ID NO: 175 - DNA, 2693 bp, Klebsiella pneumoniae
  CDS (1)..(1668): alpha subunit
  misc_feature (1)..(2693): Xba3010
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgttggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaatgagatgccgccgcgtaacgtggtggaggatctgagtgcggtggaagagatgatgaagcgcaacatcaccggcctcgatattgtcggcgcgctgagccgcagcggctttgaggatatcgccagcagtattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgctccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 176 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASSILNMLRQRVTGDYLQTSAILDRQFEVVSAVNDINDYQGPGTGYRISAERWAEIKNIPGVVQPDTIE

SEQ ID NO: 177 - protein, 194 aa, Klebsiella pneumoniae
VQQTTQIQPSFTLKTREGGVASADERSDEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 178 - protein, 141 aa, Klebsiella pneumoniae; identical to SEQ ID NO: 4

SEQ ID NO: 179 - DNA, 2693 bp, Klebsiella pneumoniae
  CDS (1)..(2265): alpha-beta subunit fusion
  misc_feature (1)..(2693): Xba3009
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcgcagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagagcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaagaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcagagagctgattgccggggtggaagaagaggggcttcacgcccgggtggtgcgcattctgcgcacgtccgacgtctcctttatggcctgggatgcggctaacctgagcggctcggggatcggcatcggtatccagtcgaaggggaccacggtcatccatcagcgcgaactgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgctatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcactcctggcatgcgacagtgaatgccgcctttgtccgggagtcggcggaagtgtatcagcagcggcataagctgcgtaaaggaagctaa

SEQ ID NO: 180 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERAEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQSGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEEGGIPVQQTTQIQPSFTLKTREGGVASADERADEVVIGVGPAFDKHQHHTLIDMPHGAILRELIAGVEEEGLHARVVRILRTSDVSFMAWDAANLSGSGIGIGIQSKGTTVIHQRELLPLSNLELFSQAPLLTLETYRQIGKNAARYARKESPSPVPVVNDQMVRPKFMAKAALFHIKETKHVVQDAEPVTLHIDLVRE

SEQ ID NO: 181 - protein, 141 aa, Klebsiella pneumoniae
MSEKTMRVQDYPLATRCPEHILTPTGKPLTDITLEKVLSGEVGPQDVRISRQTLEYQAQIAEQMQRYAVARNFRRAAELIAIPDERILAIYNALRPFRSSQAELLAIADELEHSWHATVNAAFVRESAEVYQQRHKLRKGS

SEQ ID NO: 182 - DNA, 2693 bp, Klebsiella pneumoniae
  CDS (1)..(1668): alpha subunit
  misc_feature (1)..(2693): Xba3023
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcatgtcagccgggaggaggtcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggagttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggtggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 183 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEVIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 184 - protein, 194 aa, Klebsiella pneumoniae; identical to SEQ ID NO: 3

SEQ ID NO: 185 - protein, 141 aa, Klebsiella pneumoniae; identical to SEQ ID NO: 4

SEQ ID NO: 186 - DNA, 2693 bp, Klebsiella pneumoniae
  CDS (1)..(2265): alpha-beta subunit fusion
  misc_feature (1)..(2693): 2-F4
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgctgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 187 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 188 - protein, 141 aa, Klebsiella pneumoniae; identical to SEQ ID NO: 4

SEQ ID NO: 189 - DNA, 2693 bp, Klebsiella pneumoniae
  CDS (1)..(2265): alpha-beta subunit fusion
  misc_feature (1)..(2693): 12-B1
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcgcagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagagcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaagaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcagagagctgattgccggggtggaagaagaggggcttcacgcccgggtggtgcgcattctgcgcacgtccgacgtctcctttatggcctgggatgcggctaacctgagcggctcggggatcggcatcggtatccagtcgaaggggaccacggtcatccatcagcgcgaactgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgctatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcactcctggcatgcgacagtgaatgccgcctttgtccgggagtcggcggaagtgtatcagcagcggcataagctgcgtaaaggaagctaa

SEQ ID NO: 190 - protein, 754 aa, Klebsiella pneumoniae; identical to SEQ ID NO: 180

SEQ ID NO: 191 - protein, 141 aa, Klebsiella pneumoniae
MSEKTMRVQDYPLATRCPEHILTPTGKPLTDITLEKVLSGEVGPQDVRISRQALEYQAQIAEQMQRYAVARNFRRAAELIAIPDERILAIYNALRPFRSSQAELLAIADELEHSWHATVNAAFVRESAEVYQQRHKLRKGS

SEQ ID NO: 192 - DNA, 2693 bp, Klebsiella pneumoniae
  CDS (1)..(2265): alpha-beta subunit fusion
  misc_feature (1)..(2693): 13-B7
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 193 - protein, 754 aa, Klebsiella pneumoniae; identical to SEQ ID NO: 141

SEQ ID NO: 194 - protein, 141 aa, Klebsiella pneumoniae; identical to SEQ ID NO: 43

SEQ ID NO: 195 - DNA, 2693 bp, Klebsiella pneumoniae
  CDS (1)..(2265): alpha-beta subunit fusion
  misc_feature (1)..(2693): 16-H5
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattttcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 196 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAIFDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 197 - protein, 141 aa, Klebsiella pneumoniae; identical to SEQ ID NO: 4

SEQ ID NO: 198 - DNA, 2693 bp, Klebsiella pneumoniae
  CDS (1)..(2265): alpha-beta subunit fusion
  misc_feature (1)..(2693): 1-E1
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 199 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 200 - protein, 141 aa, Klebsiella pneumoniae; identical to SEQ ID NO: 4

SEQ ID NO: 201 - DNA, 2693 bp, Klebsiella pneumoniae
  CDS (1)..(2265): alpha-beta subunit fusion
  misc_feature (1)..(2693): 22-G7
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaagaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 202 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEEGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 203 - protein, 141 aa, Klebsiella pneumoniae; identical to SEQ ID NO: 4

SEQ ID NO: 204 - DNA, 2693 bp, Klebsiella pneumoniae
  CDS (1)..(1668): alpha subunit
  misc_feature (1)..(2693): 7A-C1
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 205 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 206 - protein, 194 aa, Klebsiella pneumoniae; identical to SEQ ID NO: 3

SEQ ID NO: 207 - protein, 141 aa, Klebsiella pneumoniae; identical to SEQ ID NO: 4

SEQ ID NO: 208 - DNA, 2693 bp, Klebsiella pneumoniae
  CDS (1)..(1668): alpha subunit
  misc_feature (1)..(2693): 7C-A5
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcgacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 209 - protein, 555 aa, Klebsiella pneumoniae; identical to SEQ ID NO: 2

SEQ ID NO: 210 - protein, 194 aa, Klebsiella pneumoniae
VRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 211 - protein, 141 aa, Klebsiella pneumoniae; identical to SEQ ID NO: 4

SEQ ID NO: 212 - DNA, 2693 bp, Klebsiella pneumoniae
  CDS (1)..(2265): alpha-beta subunit fusion
  misc_feature (1)..(2693): 8-C9
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 213 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 214 - protein, 141 aa, Klebsiella pneumoniae; identical to SEQ ID NO: 4

SEQ ID NO: 215 - DNA, 2693 bp, Klebsiella pneumoniae
  CDS (1)..(2265): alpha-beta subunit fusion
  misc_feature (1)..(2693): 9-D7
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 216 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 217 - protein, 141 aa, Klebsiella pneumoniae; identical to SEQ ID NO: 4

SEQ ID NO: 218 - DNA, 2693 bp, Klebsiella pneumoniae
  CDS (1)..(2265): alpha-beta subunit fusion
  misc_feature (1)..(2693): 10-G6
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 219 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 220 - protein, 141 aa, Klebsiella pneumoniae; identical to SEQ ID NO: 4

SEQ ID NO: 221 - DNA, 2693 bp, Klebsiella pneumoniae
  CDS (1)..(1668): alpha subunit
  misc_feature (1)..(2693): 21-D10
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 222 - protein, 556 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQ

SEQ ID NO: 223 - protein, 194 aa, Klebsiella pneumoniae; identical to SEQ ID NO: 3

SEQ ID NO: 224 - protein, 141 aa, Klebsiella pneumoniae; identical to SEQ ID NO: 43

SEQ ID NO: 225 - DNA, 2693 bp, Klebsiella pneumoniae
  CDS (1)..(1668): alpha subunit
  misc_feature (1)..(2693): 20-B9
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattttcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 226 - protein, 556 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAIFDRQFEVVSAVNDINDYQGPGTGYRISAERWAEIKNIPGVVQPDTIEQ

SEQ ID NO: 227 - protein, 194 aa, Klebsiella pneumoniae; identical to SEQ ID NO: 3

SEQ ID NO: 228 - protein, 141 aa, Klebsiella pneumoniae; identical to SEQ ID NO: 4

SEQ ID NO: 229 - DNA, 2693 bp, Klebsiella pneumoniae
  CDS (1)..(1668): alpha subunit
  misc_feature (1)..(2693): 18-D7
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 230 - protein, 556 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQ

SEQ ID NO: 231 - protein, 194 aa, Klebsiella pneumoniae; identical to SEQ ID NO: 210

SEQ ID NO: 232 - protein, 141 aa, Klebsiella pneumoniae; identical to SEQ ID NO: 43

SEQ ID NO: 233 - DNA, 2693 bp, Klebsiella pneumoniae
  CDS (1)..(1668): alpha subunit
  misc_feature (1)..(2693): 17-F6
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattttcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 234 - protein, 556 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAIFDRQFEVVSAVNDINDYQGPGTGYRISAERWAEIKNIPGVVQPDTIEQ

SEQ ID NO: 235 - protein, 194 aa, Klebsiella pneumoniae; identical to SEQ ID NO: 210

SEQ ID NO: 236 - protein, 141 aa, Klebsiella pneumoniae; identical to SEQ ID NO: 4

SEQ ID NO: 237 - DNA, 2693 bp, Klebsiella pneumoniae
  CDS (1)..(1668): alpha subunit
  misc_feature (1)..(2693): 15-E4
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgctgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 238 - protein, 556 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQ

SEQ ID NO: 239 - protein, 194 aa, Klebsiella pneumoniae; identical to SEQ ID NO: 210

SEQ ID NO: 240 - protein, 141 aa, Klebsiella pneumoniae; identical to SEQ ID NO: 4

SEQ ID NO: 241 - DNA, 2693 bp, Klebsiella pneumoniae
  CDS (1)..(1668): alpha subunit
  misc_feature (1)..(2693): KG002
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgccgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaatatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgccgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacgcctggcatgcgacagtgaatgccgcctttgtccgggagtcggcggaagtgtatcagcagcggcataagctgcgtaaaggaagctaa

SEQ ID NO: 242 - protein, 555 aa, Klebsiella pneumoniae; identical to SEQ ID NO: 2

SEQ ID NO: 243 - protein, 194 aa, Klebsiella pneumoniae; identical to SEQ ID NO: 149

SEQ ID NO: 244 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSQAELLAIADELEHAWHATVNAAFVRESAEVYQQRHKLRKGS

SEQ ID NO: 245 - DNA, 2693 bp, Klebsiella pneumoniae
  CDS (1)..(1668): alpha subunit
  misc_feature (1)..(2693): KG003
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgatgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccaccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 246 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETMSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 247 - protein, 194 aa, Klebsiella pneumoniae; identical to SEQ ID NO: 3

SEQ ID NO: 248 - protein, 141 aa, Klebsiella pneumoniae; identical to SEQ ID NO: 4

SEQ ID NO: 249 - DNA, 2693 bp, Klebsiella pneumoniae
  CDS (1)..(1668): alpha subunit
  misc_feature (1)..(2693): KG004
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggcctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcttgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 250 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSAYGTEAVFTDGDDTPWSKAFLASAYASRGLKMRYTSGTGSEALMGYSESKSMLYLESRCIFITKGAGVQGLQNGAVSCIGLTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 251 - protein, 194 aa, Klebsiella pneumoniae; identical to SEQ ID NO: 3

SEQ ID NO: 252 - protein, 141 aa, Klebsiella pneumoniae; identical to SEQ ID NO: 4

SEQ ID NO: 253 - DNA, 2693 bp, Klebsiella pneumoniae
  CDS (1)..(1668): alpha subunit
  misc_feature (1)..(2693): KG005
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattaccaaaggcgccggggttcagggactgcaaaacggcgcggtgagctgtatcggcttgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgtcggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 254 - protein, 555 aa, Klebsiella pneumoniae; identical to SEQ ID NO: 49

SEQ ID NO: 255 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVSVVNDQMVRPKFMAKAALFHIKETKHVVQDAEPVTLHIDLVRE

SEQ ID NO: 256 - protein, 141 aa, Klebsiella pneumoniae; identical to SEQ ID NO: 4

SEQ ID NO: 257 - DNA, 2693 bp, Klebsiella pneumoniae
  CDS (1)..(1668): alpha subunit
  misc_feature (1)..(2693): KG006
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacacgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 258 - protein, 555 aa, Klebsiella pneumoniae; identical to SEQ ID NO: 117

SEQ ID NO: 259 - protein, 194 aa, Klebsiella pneumoniae; identical to SEQ ID NO: 3

SEQ ID NO: 260 - protein, 141 aa, Klebsiella pneumoniae; identical to SEQ ID NO: 4

SEQ ID NO: 261 - DNA, 2693 bp, Klebsiella pneumoniae
  CDS (1)..(1668): alpha subunit
  misc_feature (1)..(2693): KG007
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggccgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccccgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 262 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAAEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 263 - protein, 194 aa, Klebsiella pneumoniae
VQQTTQIQPSFTPKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 264 - protein, 141 aa, Klebsiella pneumoniae; identical to SEQ ID NO: 4

SEQ ID NO: 265 - DNA, 2693 bp, Klebsiella pneumoniae
  CDS (1)..(1668): alpha subunit
  misc_feature (1)..(2693): KG010
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataacccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagctcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 266 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQLEVVSAVNDINDYQGPGTGYRISAERWAEIKNIPGVVQPDTIE

SEQ ID NO: 267 - protein, 194 aa, Klebsiella pneumoniae; identical to SEQ ID NO: 3

SEQ ID NO: 268 - protein, 141 aa, Klebsiella pneumoniae; identical to SEQ ID NO: 4

SEQ ID NO: 269 - DNA, 2693 bp, Klebsiella pneumoniae
  CDS (1)..(1668): alpha subunit
  misc_feature (1)..(2693): KG011
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcttgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcagtggaggagatgatgaagcgcaacatcaccggcctcgatattgtcggcgcgctgagccgcagcggctttgaggatatcgccagcaatattctcaatatgctgcgccagcgggtcgccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccggtgaacgcgccgatgaggtggtgatcggcgtcggccctgccttcgataaacaccagcatcacactctgatcgatatgccccatggcgcgatcctcaaagagcttattgccggggtggaagaagaggggcttcacgcccgagtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggggacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaagaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 270 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGLRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVAGDYLQTSAILDRQFEVVSAVNDINDYQGPGTGYRISAERWAEIKNIPGVVQPDTIE

SEQ ID NO: 271 - protein, 194 aa, Klebsiella pneumoniae
VQQTTQIQPSFTLKTREGGVASAGERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLGTYRQIGKNAARYARKESPSPVPVVNDQMVRPKFMAKAALFHIKETKHVVQDAEPVTLHIDLVRE

SEQ ID NO: 272 - protein, 141 aa, Klebsiella pneumoniae; identical to SEQ ID NO: 4

SEQ ID NO: 273 - DNA, 2693 bp, Klebsiella pneumoniae
  CDS (1)..(1668): alpha subunit
  misc_feature (1)..(2693): KG012
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcgtaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 274 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGVTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 275 - protein, 194 aa, Klebsiella pneumoniae; identical to SEQ ID NO: 3

SEQ ID NO: 276 - protein, 141 aa, Klebsiella pneumoniae; identical to SEQ ID NO: 4

SEQ ID NO: 277 - DNA, 2693 bp, Klebsiella pneumoniae
  CDS (1)..(1668): alpha subunit
  misc_feature (1)..(2693): KG014
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacgtgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgaagaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 278 - protein, 555 aa, Klebsiella pneumoniae; identical to SEQ ID NO: 109

SEQ ID NO: 279 - protein, 194 aa, Klebsiella pneumoniae
VQQTTQIQPSFTLKTREGGVASAEERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 280 - protein, 141 aa, Klebsiella pneumoniae; identical to SEQ ID NO: 4

SEQ ID NO: 281 - DNA, 2693 bp, Klebsiella pneumoniae
  CDS (1)..(1668): alpha subunit
  misc_feature (1)..(2693): KG016
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgcaggaccccctccatccagtgccacgtcaccaatctcaaagacaatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaaacggtatttaccgacagcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 282 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSIQCHVTNLKDNPVQIAADAAEAGIRGFSEQETTVGIARYAPFNALALLVGSQCGRPGVLTQCSVEEATELELGMRGLTSYAETVSVYGTETVFTDSDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 283 - protein, 194 aa, Klebsiella pneumoniae; identical to SEQ ID NO: 3

SEQ ID NO: 284 - protein, 141 aa, Klebsiella pneumoniae; identical to SEQ ID NO: 4

SEQ ID NO: 285 - DNA, 2693 bp, Klebsiella pneumoniae
  CDS (1)..(1668): alpha subunit
  misc_feature (1)..(2693): KG017
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcggtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatgacgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaatgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 286 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMTQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 287 - protein, 194 aa, Klebsiella pneumoniae; identical to SEQ ID NO: 3

SEQ ID NO: 288 - protein, 141 aa, Klebsiella pneumoniae; identical to SEQ ID NO: 4

SEQ ID NO: 289 - DNA, 2693 bp, Klebsiella pneumoniae
  CDS (1)..(1668): alpha subunit
  misc_feature (1)..(2693): KG021
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggcctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 290 - protein, 555 aa, Klebsiella pneumoniae; identical to SEQ ID NO: 69

SEQ ID NO: 291 - protein, 194 aa, Klebsiella pneumoniae; identical to SEQ ID NO: 3

SEQ ID NO: 292 - protein, 141 aa, Klebsiella pneumoniae; identical to SEQ ID NO: 4

SEQ ID NO: 293 - DNA, 2693 bp, Klebsiella pneumoniae
  CDS (1)..(1668): alpha subunit
  misc_feature (1)..(2693): KG023
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgtcggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 294 - protein, 555 aa, Klebsiella pneumoniae; identical to SEQ ID NO: 2

SEQ ID NO: 295 - protein, 194 aa, Klebsiella pneumoniae; identical to SEQ ID NO: 255

SEQ ID NO: 296 - protein, 141 aa, Klebsiella pneumoniae; identical to SEQ ID NO: 4

SEQ ID NO: 297 - DNA, 2693 bp, Klebsiella pneumoniae
  CDS (1)..(1668): alpha subunit
  misc_feature (1)..(2693): KG001
  CDS (1681)..(2265): beta subunit
  CDS (2268)..(2693): gamma subunit
atgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccaactacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 298 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTNYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 299 - protein, 194 aa, Klebsiella pneumoniae; identical to SEQ ID NO: 3

SEQ ID NO: 300 - protein, 141 aa, Klebsiella pneumoniae; identical to SEQ ID NO: 4

SEQ ID NO: 301 - DNA, 2693 bp, Klebsiella pneumoniae
  CDS (1)..(2265): alpha-beta subunit fusion
  misc_feature (1)..(2693): GDH-SM1-G11
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagtcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 302 - protein, 754 aa, Klebsiella pneumoniae; identical to SEQ ID NO: 199

SEQ ID NO: 303 - protein, 141 aa, Klebsiella pneumoniae
MSEKTMRVQDYPLATRCPEHILTPTGKPLTDITLEKVLSGEVGPQDVRISRQSLEYQAQIAEQMQRHAVARNFRRAAELIAIPDERILAIYNALRPFRSSQAELLAIADELEHTWHATVNAAFVRESAEVYQQRHKLRKGS

SEQ ID NO: 304 - DNA, 2693 bp, Klebsiella pneumoniae
  CDS (1)..(2265): alpha-beta subunit fusion
  misc_feature (1)..(2693): GDH-SM2-B11
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccatttttgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 305 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAIFDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 306 - protein, 141 aa, Klebsiella pneumoniae; identical to SEQ ID NO: 4

SEQ ID NO: 307 - DNA, 2693 bp, Klebsiella pneumoniae
  CDS (1)..(2265): alpha-beta subunit fusion
  misc_feature (1)..(2693): GDH-SM3-D2
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 308 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 309 - protein, 141 aa, Klebsiella pneumoniae; identical to SEQ ID NO: 4

SEQ ID NO: 310 - DNA, 2693 bp, Klebsiella pneumoniae
  CDS (1)..(2265): alpha-beta subunit fusion
  misc_feature (1)..(2693): GDH-SM4-H2
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagtgtcttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 311 - protein, 754 aa, Klebsiella pneumoniae; identical to SEQ ID NO: 199

SEQ ID NO: 312 - protein, 141 aa, Klebsiella pneumoniae
MSEKTMRVQDYPLATRCPEHILTPTGKPLTDITLEKVLSGEVGPQDVRISRQCLEYQAQIAEQMQRHAVARNFRRAAELIAIPDERILAIYNALRPFRSSQAELLAIADELEHTWHATVNAAFVRESAEVYQQRHKLRKGS

SEQ ID NO: 313 - DNA, 2693 bp, Klebsiella pneumoniae
  CDS (1)..(2265): alpha-beta subunit fusion
  misc_feature (1)..(2693): SHGDH37
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcaagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 314 - protein, 754 aa, Klebsiella pneumoniae; identical to SEQ ID NO: 308

SEQ ID NO: 315 - protein, 141 aa, Klebsiella pneumoniae
MSEKTMRVQDYPLATRCPEHILTPTGKPLTDITLKKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 316 - DNA, 2693 bp, Klebsiella pneumoniae
  CDS (1)..(2265): alpha-beta subunit fusion
  misc_feature (1)..(2693): SHGDH51
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactgtctcccactcggatattcgccggaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcctgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 317 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTVSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 318 - protein, 141 aa, Klebsiella pneumoniae; identical to SEQ ID NO: 43

SEQ ID NO: 319 - DNA, 2693 bp, Klebsiella pneumoniae
  CDS (1)..(2265): alpha-beta subunit fusion
  misc_feature (1)..(2693): SHGDH12
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacattgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgtgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgagaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 320 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINIERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLRTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 321 - protein, 141 aa, Klebsiella pneumoniae; identical to SEQ ID NO: 4

SEQ ID NO: 322 - DNA, 2693 bp, Klebsiella pneumoniae
  CDS (1)..(2265): alpha-beta subunit fusion
  misc_feature (1)..(2693): SHGDH22
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccaaactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatggcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcataccctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctacgtaaaggaagctaa

SEQ ID NO: 323 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYGISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 324 - protein, 141 aa, Klebsiella pneumoniae
MSEKTMRVQDYPLATRCPEHTLTPTGKPLTDITLEKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 325 - DNA, 2693 bp, Klebsiella pneumoniae
  CDS (1)..(2265): alpha-beta subunit fusion
  misc_feature (1)..(2693): SHGDH38
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcgaggtagcttctgccgatgaacgcgccgatgaagtggtgatcggcgtcggccctgccttcgataaacaccagcatcacactctgatcgatatgccccatggcgcgatcctcaaagagctgattgccggggtggaagaggaggggctccacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcagtttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 326 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGEVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 327 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARSFRRAAELIAIPDERILAIYNALRPFRSSQAELLAIADELEHTWHATVNAAFVRESAEVYQQRHKLRKGS

SEQ ID NO: 328 - DNA, 2693 bp, Klebsiella pneumoniae
  CDS (1)..(2265): alpha-beta subunit fusion
  misc_feature (1)..(2693): SHGDH24
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgcgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagtggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 329 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 330 - protein, 141 aa, Klebsiella pneumoniae; identical to SEQ ID NO: 4

SEQ ID NO: 331 - DNA, 2693 bp, Klebsiella pneumoniae
  CDS (1)..(2265): alpha-beta subunit fusion
  misc_feature (1)..(2693): SHGDH43
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggaaagcaagtcgatgctctacctcgaatcgcgctgcatcttcattactaaaggcgccggggttcagggactgcaaaacggcgcggtaagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccagagccgcgctatttcatatcgaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagtcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 332 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMARAALFHIEETKHVVQDAEPVTLHIDLVRE

SEQ ID NO: 333 - protein, 141 aa, Klebsiella pneumoniae; identical to SEQ ID NO: 303

SEQ ID NO: 334 - DNA, 2693 bp, Klebsiella pneumoniae
  CDS (1)..(2265): alpha-beta subunit fusion
  misc_feature (1)..(2693): SHGDH25
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacctgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggcggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 335 - protein, 754 aa, Klebsiella pneumoniae
MKRSKRFAVLAQRPVNQDGLIGEWPEEGLIAMDSPFDPVSSVKVDNGLIVELDGKRRDQFDLIDRFIADYAINVERTEQAMRLEAVEIARMLVDIHVSREEIIAITTAITPAKAVEVMAQMNVAEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 336 - protein, 141 aa, Klebsiella pneumoniae; identical to SEQ ID NO: 4

SEQ ID NO: 337 - DNA, 2693 bp, Klebsiella pneumoniae
  CDS (1)..(2265): alpha-beta subunit fusion
  misc_feature (1)..(2693): SHGDH29
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgctggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccatttttgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcgggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 338 - protein, 754 aa, Klebsiella pneumoniae; identical to SEQ ID NO: 305

SEQ ID NO: 339 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSRAELLAIADELEHTWHATVNAAFVRESAEVYQQRHKLRKGS

SEQ ID NO: 340 - DNA, 33 bp, Artificial Sequence
  T53-SM
  misc_feature: N = a, g, t or c
  misc_feature (18)..(20): n is a, c, g, or t
tgcggatctcccgccagnnncttgagtaccagg

SEQ ID NO: 341 - DNA, 39 bp, Artificial Sequence
  L509-SM
  misc_feature: N = a, t, g or c
  misc_feature (19)..(21): n is a, c, g, or t
ctgcagacctcggccattnnngatcggcagttcgaggtg

SEQ ID NO: 342 - DNA, 33 bp, Artificial Sequence
  V224-SM
  misc_feature: N = a, t, g or c
  misc_feature (16)..(18): n is a, c, g, or t
agctacgccgagacgnnntcggtctacggcacc

SEQ ID NO: 343 - DNA, 48 bp, Artificial Sequence
  GDHM-F1
tttcaagctataccaagcatacaatgaaagcttaaggaggttaattaa

SEQ ID NO: 344 - DNA, 23 bp, Artificial Sequence
  GDHM-R1
ctagattagcttcctttacgcag

SEQ ID NO: 345 - DNA, 23 bp, Artificial Sequence
  GDHM-F2
agcttaaggaggttaattaaatg

SEQ ID NO: 346 - DNA, 46 bp, Artificial Sequence
  GDHM-R2
gaggctagttattgctcagcggtctagattagcttcctttacgcag

What is claimed is:

1. A method of screening for $B_{12}$-dependent dehydratases having improved reaction kinetics, comprising:
    (a) contacting a $B_{12}$-dependent dehydratase holoenzyme with a mixture comprising glycerol and 1,3-propanediol, wherein the 1,3-propanediol is at least 25 mM; and
    (b) screening the $B_{12}$-dependent dehydratase holoenzyme to estimate the turnover ratio of the $B_{12}$-dependent dehydratase.

2. A method for identifying $B_{12}$-dependent dehydratase with improved reaction kinetics relative to a reference dehydratase comprising
    (a) providing a population of mutant dehydratase holoenzymes;
    (b) separately contacting each mutant dehydratase holoenzyme with 5-10 mM glycerol 10-300 mM 1,3-propanediol;
    (c) measuring at least two time points in a high throughput assay sufficiently separated to estimate $k_{cat}$ and total enzyme turnover for each mutant dehydratase holoenzyme of (b);
    (d) separately contacting the reference holoenzyme with 5-10 mM glycerol 10-300 mM 1,3-propanediol;
    (e) measuring at least two time points in a high throughput assay sufficiently separated to estimate $k_{cat}$ and total enzyme turnover for the reference holoenzyme of (d); and
    (f) selecting a $B_{12}$-dependent mutant having improved reaction kinetics relative to the reference dehydratase, said kinetics determined by comparing the measurements of step (c) with the measurements of step (e).

3. A method for identifying $B_{12}$-dependent dehydratase with improved reaction kinetics relative to a reference dehydratase comprising
    (a) providing a population of mutant dehydratase holoenzymes;
    (b) separately contacting each mutant dehydratase holoenzyme with 5-50 mM glycerol and >300 mM 1,3-propanediol;
    (c) measuring one time point in a high throughput assay sufficiently separated from T0 to estimate the total enzyme turnover number for each mutant dehydratase holoenzyme of (b);
    (d) separately contacting the reference holoenzyme with 5-50 mM glycerol and >300 mM 1,3-propanediol;
    (e) measuring one time point in a high throughput assay sufficiently separated from T0 to estimate the total enzyme turnover number for the reference holoenzyme of (d); and
    (f) selecting a $B_{12}$-dependent mutant having improved reaction kinetics relative to the reference dehydratase, said kinetics determined by comparing the measurements of step (c) with the measurements of step (e).

* * * * *